United States Patent 11,098,302 (IDENTIFICATION OF POLYNUCLEOTIDES ASSOCIATED WITH A SAMPLE) - sequence listing, part 58

SEQ ID NO: 199230 - DNA, 668 bp, Homo sapiens
  misc_feature: GYAE6OF02FYXWW.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccactctcctgcacgtcggaaccagcagtgacgttggtgttaataactatgtctccgtcggtaccaacacgccacccaggacaaacgcccccaaactccatgtattatgatgtcaactaagtccgccctacgtagggtttactaactcgtcttctcgtacggtcctaccgtaacgtcgtacgacctaacgacccggtcccgtcccgtcggaaccctacgttaccgtccgtcgggtccctccgtaggctaggtacggacggacgtcctagtactttaattacgtgtacgagtcctacgtaataactacgaaacgcctaaccgagtaccacgttcctacttacgtcgttaccgttacgaaccggtaccggggaaccctaagggttccctaacccggttaccgttaacggccgttaaccgggaccccgttaaccgggaccccctaacccccgtattaccccgg

SEQ ID NO: 199231 - DNA, 629 bp, Homo sapiens
  misc_feature: GYAE6OF02FVLJ1.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctcctggtaccaacacgcaccgagacaaacgcccccaaactcatgtatttatgtatgtactaactaactccggtccctgtacgggtttctaacgtcgtcttctcgtcggtccttaccgtaagtccgtaggaccaaaccgaccggccccttaccctacgaccctattccttacgtcgggcctccgaggtcgtaggacggacgaggctagtaacttacttacgtcgctacgtctacaactaactaaccaacgaccaaccacgtacctaccttacttacgtattcgttaccgtaccggaacgtcgggaacctaacgggtaccctaccggttaccgtacggtaccgaccgaccccgaacggtaccccacccgtaccg

SEQ ID NO: 199232 - DNA, 676 bp, Homo sapiens
  misc_feature: GYAE6OF02IHQ5B.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctccgtgtctgggtctcgtggacagtcgatcaccatctcctgcactggaaccagcaggtgacgttggtagttaataactatgtcctctaggtaccaacagcaccaggacaaaccgaccccaaactcatgtattatgatagtacactacgcgcctcgtaggttactatctcttctctggctacgtaacgtcgtacgacaaaccgcggtaccctccgtaccgactatccgtcgtcgggctaccgaggtcgtacgggacggacggtacggacgttagtaacgtttacttaaccgtcgtaccacggtactaccgtaaattactaaaccgtacgaacccgaaccgtaaccgtaccttaaccttaccgttattaccgttacggtttacgtttaaacccgggtaaacgggttaccgggtaaacccggttaaaccggttacccgttaccccggttacccggttaggtaaccccggaacgtacccccgtaaaccgggaaccccccg

SEQ ID NO: 199233 - DNA, 725 bp, Homo sapiens
  misc_feature: GYAE6OF02JZ1VU.18.59.F04.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcgtcctgcacgtggaaccngcagtgacgttggtgttataactntgtctctggtaccaanacgacaccgagacaaaccgcccccaaactcatgtatttactagacgtgtaccaacttaacgtcccgtacccgtacggttacggggttttactaacgttccgtaccgtttccttaccgtcgggttacccttaccgtaaacgtttccggtacggaaccctaaacccggtacccgggtacccccttaccccgtaccggaacccttaccgttccgttaccggtcggtaccctccggtaacgggtaccgttacgggaacgggtaaccggtagggtccttaggtaacgtttacgttacgtacgacgtacgtctacgtaataactaaccgacgtacctaaccgcgtacctacgttcctacgttacgtcgttaccgtacgtaaccggtcgtaaccggtaacgtcccgtaaccgttaactacggtaccgaccgtaacccggaaccgtacccctaaccgttccg

SEQ ID NO: 199234 - DNA, 671 bp, Homo sapiens
  misc_feature: GYAE6OF02HD7QK.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacagtcgatcgacatctcctgacactcggaaccagcagtcgacgttcggtagttatactatgtctcgtaggtaccaacgagcaccaggacaaacgccccaaatcatgtacttatgtatcgtacactaactccggccgtacgtacgggtttacaacgtcgtcttcgtgtcggccttacgaagttcgtacggacaacgaccggtcccttaccgtacgacctattccgtacgtacgggtacctaccgtaggtacgttaggaaacgggacggtaaggtccgttagttaacgtttaacgttacgtacgcgtaacgtcctactaataacgtaccgaaacggtccaaacctacgacctacttccctagttactcggttaccgttaaccggtaccgtacgggtaaccctaacgggtacccgttaaccggtccggttaacggtcccgtaacggaccccgaaccggtacccgaaccctaaccgg

SEQ ID NO: 199235 - DNA, 765 bp, Homo sapiens
  misc_feature: GYAE6OF02JELHI.18.59.F04.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (316)..(316): a, c, t, g, unknown or other
  misc_feature (316)..(316): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccngcagtgacgttggtagttataactatgtctcctggtaccaacagccacccaggaccaaacgcccccaaatccatagtacttttanagtatgtacctaacttaacgttccggtccccttacggttacggggttttacctaaacgttccggtacctttccgttcgttcggtaccctttacccgtaaacgttccgtacggacctaaacccgtacccgggtccccttaccccgtacgaaccctacttcccgtttaccgggtcgggtaccctaccggaacgggtccgttagggaaccgggaaccggtacgggtccgttagttaaacgttttacgtttaccgtacgtaccgtaacggttcccttaacgttaacttaaaccgttaacaacccggtaaccaacccgtaacgacccgttaaccttacgttaccttacgtttcggttacccgttaccgggtaaccgttcgggaacccgttacgggtacccttacccggtaccgttacgggtacccacccggtacccgaacccggtaaccccccg

SEQ ID NO: 199236 - DNA, 687 bp, Homo sapiens
  misc_feature: GYAE6OF02GA04T.18.59.F04.1.454.CMB.1.raw
  modified_base (271)..(271): a, c, t, g, unknown or other
  misc_feature (271)..(271): n is a, c, g, or t
tcagtacgagtatgcacgaccggtgctcgatttagtacacacacttagggattggggggggtctcaggaggcagcgctctcgagacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctcctggtaccaacngccacccaggacaaacgcccccaaactcacgtagtattttatacgtatcgttacaacttaactccggtacccctcgtacgggggttttactaaacgtccgtctttcttcgtcggtcctaccgtaagttcgtggacctaaccgacccggtcccttcccgtacgacctacgttcctcgtcgggtcctaccgacggtctcgggaacggacggacgtcgttgtaatttacgtttacgtagacgtacggtaccttacgtaattacgtaaccgaacgtacccgaaccgtacgaccctaccttacctcgtttaacgttcgtttaccggttacccgggtaacggtaaccgggtaacccgtaacggttcccgtacccggttaccggtacggtacccacggtaccccgacggacccctaaaccccg

SEQ ID NO: 199237 - DNA, 638 bp, Homo sapiens
  misc_feature: GYAE6OF02FU7E4.18.59.F04.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (413)..(413): a, c, t, g, unknown or other
  misc_feature (413)..(413): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctgggacagtcgatcaccatctcctgcactggaaccngcagtgacgttggtgttataactntgtctcctggtaccaacagccacccaggccaaacgcccccaaactcatgatttatgatgctactaatccggccctcgtaggggtttctaatcgcttctctggctccaagtctggacaacaccggccctccctagacctagtctcgtacgggcctaccgnggtcctaggacggacgtactcggaccttaggtaactttactttacgtcgtaccgtacgtaccttacgtaacttaacgtaacaacgaccctaaccgaacgcctaacttccgttactatttccgttaccgttacggtaacggtacgggtaacccgtaacgggttccctaccggttacccgtacggttacccgaaccggtaccccgtaaccggtacccctaacccccg

SEQ ID NO: 199238 - DNA, 773 bp, Homo sapiens
  misc_feature: GYAE6OF02GZQ5G.18.59.F04.1.454.CMB.1.raw
  modified_base (254)..(254): a, c, t, g, unknown or other
  misc_feature (254)..(254): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagcaccaggacaaacgcccccaaactcaatgtatttatagatgtcactaagtccggccctcgtaggggtttactaatcgtacttctcgtcggtctaccgtaacgttctacggacctaaaccgaccgggtcccctaccccgtacggtaaccctacgtttacccgtaccgtcggggtaccctacccggtaacgggtacgttacggggaacgggtaaccgggaacgggtaccgttaggtaactttaacgttaccttcggtacgtaacggtaccttacctaaagttaaccttaaacccgaaacgacccgtaacccgaacggtaccctaaccgttacctttaccgttaacgtttccggttacccggtttaaccgggtaaccggttaaccggggtaacccggttaaaccgggttacccgttaaccccgggttaacccggttaacgggttacccgtaaacccgggtacccccgtaaacccggggtacccctaaaccccccggtaaccgg

SEQ ID NO: 199239 - DNA, 638 bp, Homo sapiens
  misc_feature: GYAE6OF02FW11N.18.59.F04.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtaggttataactntgtctcctggtaccaacagccaccaggcaaacgccccccaaactcatgtatttagtgatcgtacactaactccggtcctacgtagggttttctaactcgtcttactcgtcggtctaccaagttcgtacggaccaaacgacccggtcccctacccgtacggacccacttccgtccgtcgggtccctaccggaggtccgtaggacgggtacgacggtctaggtaatttacgttacgtgacctagtccttacaagttaactacgaacgacctaaccgacgtctaacctcgttactagttccgtacgttacggaaccgtccgggtaactacgggtacctaccgttaccgtacgtccgaaccgacccgaacggtaccccaaccgtaccg

SEQ ID NO: 199240 - DNA, 584 bp, Homo sapiens
  misc_feature: GYAE6OF02ITG9N.18.59.F04.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagtacgagtatgcacgaccggtgctcgatttagtacacacacttagggagttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccagtctcctgcactcggaaccngcagtgacgttggngttanaactntgtctctggtaccaacagcaccaggacaaacgccccaaactcactgtatttactgaatcgtacactaacgtccgcctcgtacgggtttacaatcgtcttctctcggctctaagtctaggacaacgtaccgcctccgcgaccattctcgtcggtactccgaggctagacggacgcgctgtattacgtacncgacgtctnatactacgaacgtcctaacgcgctacctcgtacttaacgtcgttccgttacggacgttacggaacccgtaaggtcccgtaccgttacgtacgtcgtaaccgacccgtaacggacccctaacccgtatcccgg

SEQ ID NO: 199241 - DNA, 642 bp, Homo sapiens
  misc_feature: GYAE6OF02H4U4Q.18.59.F04.1.454.CMB.1.raw
  modified_base (211)..(211): a, c, t, g, unknown or other
  misc_feature (211)..(211): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (627)..(627): a, c, t, g, unknown or other
  misc_feature (627)..(627): n is a, c, g, or t
tcagtacgagtatgcacgaccggtgctcgatttagtacacacacttagggattgggggcgtttgtcctgggtctcctggacagtcgatcaccatctcctgcactggaaccagcagtgacgtttggtggttataactatgtctcctggtaccaacagcacccaggcaaagcccccaaatcatgatttatgatgtcacttaagtcggtccctntaggggtttctaatcgtcttctctggctcaagtctcggcaacgacggctccctgaccntctctggctctagctgaggacgnggctgtacttattacgtgacgtagcgtctaagtaactacaacgtccaaccgagtaccaccttactacttactacggttcttaccggtaacggtcgggaacctaacgggtacctacccggtaacgtaggtacctacggaacccaacgggttaaccccaacccgtactaccgtacgtacctttctccgttacccctaccttcccgtactaccgttaccgttaccgttaccacggtaccggtccgggtcgtaccggtacgtaaacgggaccgtacgtaacgttaaggccttaacgcgatcgtagtacctgtcgagtcactactactacgagtacgtcncacgactacgtctcg

SEQ ID NO: 199242 - DNA, 868 bp, Homo sapiens
  misc_feature: GYAE6OF02IQERJ.18.59.F04.1.454.CMB.1.raw
tcagtacgagtatgcacgaccggtgctcgatttagtacacacacttagggattggggagctctgggagaggagcccagccttgggattcccaagtgttttctattcagtgatcaggactgaacacagaggactcaccatggagtttggctgagctggatttccttgctgcttatttaaaggtgtcctagtgtgaggtgcagctgggtggtagtcggtgggggtaggtacgttaggggtaaacgggcccggggggggttaccctttagggacccttcccccggttaggttaccgaggtccccgttcgtacggggtaactttccgtacgttttacaacggttaacggtccgttagggtaacgttaggtaaaccgttcggggtcccgacccggtagggtccccgttaacccgggaacggggggtaacgggggtccggttaggggtacgggtttcgggggtttacgggacccgggtttaaaacttttaaaaaacccggaaaacgtttgggtaacggttacgggggacggggtaaaccaaaccgtaggtaaacccttacgggaccgttacggacccgtaacccgggtaaggtaaaacggcgtaaacggtactttacccgaaacctagttaccgtaacgtaaacggtagaacttaggtaaacttaacgaaaaacggccctaacgggtacctagttaccgttaactagtaaccaaacgtagaaacgaccgtccgtaacggtaacggaaccggtaacgaacggactaaccgggtccttaacggtaacttacgtacgtacccgaacctaccgtaccccgtaagacgtacctactaactacccgtaataccgtaaggtactacccggtatacccgggg

SEQ ID NO: 199243 - DNA, 654 bp, Homo sapiens
  misc_feature: GYAE6OF02IW1U8.18.59.F04.1.454.CMB.1.raw
  modified_base (486)..(486): a, c, t, g, unknown or other
  misc_feature (486)..(486): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtcacgtgtgaggtgcagctggtggagtcgtggggggaggcttgggtaaacggccgggggggtcccttaggacctccccctgtacagcctctggattcactttcagtaaggcctaggatagaacgtcgggtccgaccaggctccgaggggaggggcgtgggaggtggggttggccgttaaagttaaaaccaaacgtagagtggtagggaacaacgagactacgctcgccaccggtagaaaggcaggataccaccatacctacaagagattagaacttaacaaaaaggcacgctagtactcgtanacaagtacaacgacgaccgtagaaacgaaccggaacgaaccacgaacgtcgtaagttaactacgttacgaaccactacctccctaaggaacgtaccgttacctaaacttaacctaaccgttaacgtaccggttagttaccggaccgttaccggtaccgggtaacccgg

SEQ ID NO: 199244 - DNA, 694 bp, Homo sapiens
  misc_feature: GYAE6OF02HCE26.18.59.F04.1.454.CMB.1.raw
  modified_base (186)..(186): a, c, t, g, unknown or other
  misc_feature (186)..(186): n is a, c, g, or t
  modified_base (646)..(646): a, c, t, g, unknown or other
  misc_feature (646)..(646): n is a, c, g, or t
  modified_base (654)..(654): a, c, t, g, unknown or other
  misc_feature (654)..(654): n is a, c, g, or t
  modified_base (659)..(659): a, c, t, g, unknown or other
  misc_feature (659)..(659): n is a, c, g, or t
  modified_base (662)..(662): a, c, t, g, unknown or other
  misc_feature (662)..(662): n is a, c, g, or t
  modified_base (671)..(672): a, c, t, g, unknown or other
  misc_feature (671)..(672): n is a, c, g, or t
  modified_base (676)..(676): a, c, t, g, unknown or other
  misc_feature (676)..(676): n is a, c, g, or t
  modified_base (684)..(684): a, c, t, g, unknown or other
  misc_feature (684)..(684): n is a, c, g, or t
  modified_base (690)..(693): a, c, t, g, unknown or other
  misc_feature (690)..(693): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttangatgtcactaatccggccctcgaggggtttctaatcgcttctctgctcaagtctggcaacacggccctccctcgaccatctcgtcgggctccgaggctaggacggacggaggctgtatttacgttacgtcgacgacgtctacgaattaactaacaacgtcgaacgccaacggtaccacgtacgtaaacggttccgttaccggggaaccggttacggggtaaacccgtaacggttacccgtaacccggtttacccggtacggttaccgaaccggacccccgaaaacgggtacccccaaaccccgtaccgtaccgttaacccttaacccgttcccgtttaccccgtttaccccccaccccgtttcccctaaaccgttaccttacccgttaccggttaccgtcggaaccgggtccggggtaccttacggggaccgtaaccggggccgtaacgacgtacggacngtacgacncgcgnacncgcgcgtcnncacncgacgtcncgcgcnnnnc

SEQ ID NO: 199245 - DNA, 612 bp, Homo sapiens
  misc_feature: GYAE6OF02FFMZ3.18.59.F04.1.454.CMB.1.raw
tcagtacgagtatgcacgaccggtgctcgatttagtacacacacttagggattggggagagaagacaggattcaggacaatctccagcatggccggcttccctctcctcctcaccctcctaactcactgtgcagggtcctgggcccagtctgtgctgactcagccaccctcagcgtctcggggccccagggcagagggtcagcatcaactgcacgtgggaccagttccaacatcggggcaaattatgatgtacactggtaccagcaacttccaggaacacgacccccaaacttcgtcatctatcggtaacaataatccggcctcgacggggtccctggaccgtattcctctcggcctccgaacgtctcggcctacctccacgtccctccgtcggcccatccacgtcgggcctccgaggcctggaggtatggagtctagaactacttacgcgtcctacgttcctatcgactagtcggaggtctgggtacgttcggttacgtattcggttcgtttacggagttccggacgggaccgtaacggcctaacccggtacccgttaagtcccgaaccggtacccgaacccggacccctaaccccgtcgttaccgtaccc

SEQ ID NO: 199246 - DNA, 737 bp, Homo sapiens
  misc_feature: GYAE6OF02INDXM.18.59.F04.1.454.CMB.1.raw
  modified_base (312)..(312): a, c, t, g, unknown or other
  misc_feature (312)..(312): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagtcttggtaaacgccgggggggtcccttagacctccctgtacacgcctctggacttcgtactttcagtaaggcctggatgaacgtgggtaccncgagctaccgaggggaaggggctgggagtgggttcggaccgttaataaaaccaaaacgtggacgtagggtggaacaacagaactacgactagaccgaccgtagaaagcagtacttacaaccatacctacaaagagtatagtaaacttaacgaaaaaagccgtaaacgtacgttacgttaaacttcggtaacgtaaccgtaaaaacgttacggaaaacgtaaccggtaacccgtaggaaaaccggtaaaccggaaacggtaacccgaaccgtacggtacccggtttaagtaaacctttaaccgtaaccggtaaccctactacccgttaaccccgtacggaaaacgtacccgttaacctaaaccttacgtaaaccttaacggttaccggttaacgtacggtacccgttacggtacgggtaaacccgg

SEQ ID NO: 199247 - DNA, 651 bp, Homo sapiens
  misc_feature: GYAE6OF02IZ0P2.18.59.F04.1.454.CMB.1.raw
  modified_base (232)..(232): a, c, t, g, unknown or other
  misc_feature (232)..(232): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccngcagtgacgttggtgttataactatgtctcctggtaccaacagccaccagcaaacgccccaaactcatgattatgatgtcactaatccggccctcgtaggggtttactaacgttcgtcttccgttactcggtctaccgaacgttcgtacgtaccaacgtacccggccctccctacgaccctacgtccttcggtacggcctccgacggtacgtacggtaacgggaaccggacggtcgttagtaagtttaactttacgtcgtaccaaggtcctaagtaacttaactaacgtaacgaccaaccctagaccttaaccgtctaccgttacttcgttaccgttacgggtaaccggtacgggtaaccgtaacggtcctaacccggttaccgtacggtaccgaccggtacccgaaccggtaaccccc

SEQ ID NO: 199248 - DNA, 713 bp, Homo sapiens
  misc_feature: GYAE6OF02HUXCV.18.59.F04.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggagttggggggggtctcaggaggcagcgctctcgggacgtctccacccatggcctgggctctgctattcctcaccctcctcactcaggcacaggtcctgggcccagttctgccctgactcagccctgcctccgtgtctgggtctccgtggacagtcgatcaccatctcctgcactggaaccngcagtgacgttggtgttataactntgtctctggtaccacagcaccgngacaaacgccccaaatcatgattttangatgtacactaagtccgaccctgtagggtttacaagtccgtcttctcgtggcctcaagttctaggacctaaacgtaccggtccctaccctgtaacccaacttcccgtacgttcggggcccttaccggagggtccgtaagggacgggtaaccggtaggtacctaggtaacttttaacgtctaggccaacgtctaaccgtataacgttaccgaacgtcccgtaacccgtaacgtcccttaaactccgttaaccgtttaacgttccgggtttaacccgttaccgggaaaacgggttcccgggtaaaccccggtaaacgggtccccggttaaacccggtttcccggtaaaccggtacccgttacccggtaaacccccggaaccgggttaacccccctaacccccgttaacgg

SEQ ID NO: 199249 - DNA, 554 bp, Homo sapiens
  misc_feature: GYAE6OF02F8TOZ.18.59.F04.1.454.CMB.1.raw
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
  modified_base (439)..(439): a, c, t, g, unknown or other
  misc_feature (439)..(439): n is a, c, g, or t
tcagtacgagtatgcacgaccggtgctcgatttagtacacacacttagggattgggggctttgcctgggtcctgggcccagtctgcctgactcagcctgcctccgtgtctgggtctcctggacagtcgatcaccatctcctgcactggaccagcagtgacgttggtggttataactatgtctcctggtaccaacngcacccaggcaaagccccaaactcatgatttangatgtcactaatcggccctgaggggtttctaatcgtctttctctggctaccaagtctggcaacncggtcctccctagacccatcctcgtgggctccgaggctgagggacgaggctgattatactgcagctnatatacaagcagcagcaactcaagtcttacggaactgggaccaaggtcaccgtctacggtcacgcccaaggcccaacccngtcgtacactccgtcgttaccccacccttccctacctactaccgtctacgtcggaccgccgggtactcgggaccaacgggtccgaccgtacgtaacgctcgactacgcgtactcg

SEQ ID NO: 199250 - DNA, 632 bp, Homo sapiens
  misc_feature: GYAE6OF02HO2BF.18.59.F04.1.454.CMB.1.raw
  modified_base (324)..(324): a, c, t, g, unknown or other
  misc_feature (324)..(324): n is a, c, g, or t
  modified_base (479)..(479): a, c, t, g, unknown or other
  misc_feature (479)..(479): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtcgtgggtcctccgtggacagtcgatcaccatctcctgccactggaaccagcaggtgtacggttggtggttaataactatgtcctctacggtaccaacagccacccgaggaccaaaccgcccccaaactcatagtatttangatgtacactaacgtccgcctaggtacgggtttactagtccgtcttcctcgtggtcctaccgagtctggacaacgccgtccctaccgtcgacctacttcgtcgtcgggtcctaccgaggtcgtaggacgggacgtaggtctagtatttacgtcgngtacagtctactatactaacgacgaccaaccgctacctacttacgtcttaggttccgttacgttaccggtaacgtcgggaaccgttaccggaccgtacccggttacgttacggtaccgtaacccgacccggtaacgaccccctaacccgtacg

SEQ ID NO: 199251 - DNA, 631 bp, Homo sapiens
  misc_feature: GYAE6OF02FXDZE.18.59.F04.1.454.CMB.1.raw
  modified_base (278)..(278): a, c, t, g, unknown or other
  misc_feature (278)..(278): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggaccagtcgatccaccatcctcctgcactcggaaccagcagtgtacgttggtaggttataactatgtctcctagtaccaacngaccaccaggacaacgacccccaaactcatgtattatagtatgtcaactacgtccgtccctagtacgggttactacgtcgtcttctacgtgtcctacaacgtctacggacaaccgaccgtccctcctacgacctatccgtcgtcggtcctaccgagtcgtaggacggacggtacgacgtagttacttattactggtcctagtctactaataactaaccgacgacctaacgactacctacctacttacttagttcgttaccgttaccggacggtacggtaacccgtaacgttacccgaacccggtttccgaacggtccaaccggtccccgaaaccggtcccccaaccgtacccg

SEQ ID NO: 199252 - DNA, 668 bp, Homo sapiens
  misc_feature: GYAE6OF02JDXFM.18.59.F04.1.454.CMB.1.raw
  modified_base (212)..(212): a, c, t, g, unknown or other
  misc_feature (212)..(212): n is a, c, g, or t
  modified_base (239)..(239): a, c, t, g, unknown or other
  misc_feature (239)..(239): n is a, c, g, or t
  modified_base (574)..(574): a, c, t, g, unknown or other
  misc_feature (574)..(574): n is a, c, g, or t
  modified_base (661)..(661): a, c, t, g, unknown or other
  misc_feature (661)..(661): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcaccnggacaaacgccccaaatcatgatttangatgtacactaacgtccgcctcgtagggtttactaagtcgtcttctcgtgctaccgagtctacggacacgaccggtccctccacgaccatctcgtcggtcctcgacgtcgtggaacgtacgaggtctagtaacttttagtaactcgacgtacgtactactaagttaacgaacaacgccaaccgaacgtacctacctttctacgttacgtcgttaccggttacggtaacggaccggtaaccgaacggttacctacccgttacgtaacgtccgaaccgtacccggaaccgtaacccaaccgtacgtactcccgtaaccttccgttcccgttaacccnccctacccgtaccttagtacccgttacgtaccggtacggacgggtcccggtagtacccggagtaacccgggcgtaaccgacggtacncgttgac

SEQ ID NO: 199253 - DNA, 667 bp, Homo sapiens
  misc_feature: GYAE6OF02HNKRC.18.59.F04.1.454.CMB.1.raw
  modified_base (652)..(652): a, c, t, g, unknown or other
  misc_feature (652)..(652): n is a, c, g, or t
  modified_base (660)..(660): a, c, t, g, unknown or other
  misc_feature (660)..(660): n is a, c, g, or t
  modified_base (666)..(666): a, c, t, g, unknown or other
  misc_feature (666)..(666): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcaagtaatcggccctcgtaggggtttctaatcgtctttctctggctccaagtctggcaacacgcctccctgacctatctcgtcggcctccgaggctggaggacgaggctaggtaatttacttacgtgacacgtctactataactaacgagacagcaagcctaacgtactaaacggtttccttacgggtaaccgtcgggaacccgtaaggtcccgtacccgttaccgtacgggtaccaaccggtaccccgaaacccggacccctaaaccccgtcttaccggtaccctaaccgtttccgtacccgtttccccccgcccttaccctaacccgtactttaacccgtccgtttaacggcgtaaccgggccgggttccgttaaccgggaccggtaaacggggtccctaacgtacgttacggntacgtacncgcganc

SEQ ID NO: 199254 - DNA, 624 bp, Homo sapiens
  misc_feature: GYAE6OF02G9FI8.18.59.F04.1.454.CMB.1.raw
  modified_base (399)..(399): a, c, t, g, unknown or other
  misc_feature (399)..(399): n is a, c, g, or t
tcagtacgagtatgcacgaccggtgctcgatttagtacacacacttagggattggggagctctgggagaggagccccgagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggtaaaggccgggggggtcccttagacctcccctgtacagcctcgtggattcgactttcagttaaggcctggatgaacgtgggtccgcaggctccgagggagggctgggagtgggtggcgtagttagagacaagcaactagttacgcgacgagcaatatgctgcgtcggngaaaggctaggtccaccgtctccaagtaaatgtattacgaaagtaacgaacggacgtactctagactaaagtacgtaacacgaccgtaacggaaaccggtaacggaaccgaaccgggaccgttacgttaagttacctagtaactaggacgaggtaggtattacgtaggttaggggtagttacgttcggacgggtaacgggggttacgtacggtacggtagtacgg

SEQ ID NO: 199255 - DNA, 690 bp, Homo sapiens
  misc_feature: GYAE6OF02G7CNB.18.59.F04.1.454.CMB.1.raw
  modified_base (533)..(533): a, c, t, g, unknown or other
  misc_feature (533)..(533): n is a, c, g, or t
tcagtacgagtatgcacgaccggtgctcgatttagtacacacacttagggagttggggggggtcgtcaggaggcagcgctctcgggacgtctccaccatggcctgggctctgctattcctcaccctcctcactcagggcacgacgggtcctcgggcccagtcctgcccctgactcagcctgccctccgtgtctgggtcctccgtggacagtcgatcaccgatcctccgtgacactaggaaaccagtcaaggtcgtacggtttgggttagtttaactaacttagttcgttctccgttacggtaacccaacgacaccaacccgaggaacctaaaaccgacccccctaaaatccatagtatttatagaactgtacaagtaactccggccttaggtaacgggtttactaatccgttcttctcgtcgtcctaacgtaagtctcggaacaacgacccgtctccccggtataccatccgtacgtcggcctaccggacgtcgtaggacgggtacgacggtagtacgtaatttacgttacgngacgtatctacaaattacgtaaccgacacgaccaacttcctaactctacgttatcgtttaccttacggaacccgttaagggaaccccttaagggtcccctacccggttaccttaacgggccaaccggaacccgacccggttaacccaccccgtaacg

SEQ ID NO: 199256 - DNA, 731 bp, Homo sapiens
  misc_feature: GYAE6OF02IQW8J.18.59.F04.1.454.CMB.1.raw
  modified_base (150)..(150): a, c, t, g, unknown or other
  misc_feature (150)..(150): n is a, c, g, or t
  modified_base (209)..(209): a, c, t, g, unknown or other
  misc_feature (209)..(209): n is a, c, g, or t
  modified_base (270)..(270): a, c, t, g, unknown or other
  misc_feature (270)..(270): n is a, c, g, or t
tcagtacgagtatgcacgaccggtgctcgatttagtacacacacttagggagttggggggggtctcaggaggcagctctctcgggacgtctccaccatggcctgggctctgctattcctcaccctcctcactcagggcacacgggttccngggcccagtctcgccctgactcacgtcctgccctccgtgtcgtgggtcctccgtggacncgtcgatcacctatctcctgcacgtacggaaccaagagtcgacgtttggtgttaataactntgtcctctacggtaaccacagaccaccgaaggaccgaaaaccgacccccaaaactctaatacgtaatttacgagtaacttctactaacgtaacgtccggtcctaacggtttacgggtttactaacgtcttaccgtttccgtacgttcggtcctacgtaaacgtcgttacggacaaccggaccggtccttacccgtcgtaaccttacgtccttccggtcggtaccgtacgacggtcgtacggtaacgggaaccgtacggtacgtacgttaagttacgttacgttacgaacgttacggaccttacggtaactaacgttaaacgacgtaaccgtaaccaacggtaaccttacttacccgttaaagttccttacgggttacctagtaaccggtaccgtaaacgttaccgtacgtacccggtacgtacggtactacccgaccgaaccgcccgtaaccctggtaccc

SEQ ID NO: 199257 - DNA, 682 bp, Homo sapiens
  misc_feature: GYAE6OF02GC3TV.18.59.F04.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcatcaccatctcctgcactggaaccngcagtgtacgttggtagttataactntgtctcctggtaccaanacgccaccgaggacaaacgacccccaaactcactgtatttagtgtatggtactaactaagtcccggtcccttcggtacggggtttactaacgttccgtctttactcgtacggtccttaccgagttcgtaggaccaaccgaccggtcccctcctacgaccctcttacctcggttcggtccttaccgaggtccgtagggacggtaccggtacggtcttagttaacgtttaagttaaccttggtaccgacgttccgttaacctaataactaacgtaacgaccctaacggacgtacctaccttcttaccgtaacgtttcgttaccgttccggtaaccggtcgggtaaaccgtaacgggtccaaccggttccgtacggtacgcccgtaacccgacccgacccgtacccctaaccgg

SEQ ID NO: 199258 - DNA, 570 bp, Homo sapiens
  misc_feature: GYAE6OF02GO4A6.18.59.F04.1.454.CMB.1.raw
  modified_base (284)..(284): a, c, t, g, unknown or other
  misc_feature (284)..(284): n is a, c, g, or t
  modified_base (312)..(313): a, c, t, g, unknown or other
  misc_feature (312)..(313): n is a, c, g, or t
  modified_base (371)..(371): a, c, t, g, unknown or other
  misc_feature (371)..(371): n is a, c, g, or t
  modified_base (447)..(447): a, c, t, g, unknown or other
  misc_feature (447)..(447): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacacgggtcctgggcccagtctgcccctgactcaacctgcctccgtgtctgggtcctcctggacagtcgatcaccatcctcctgcactggaaccagtcaggtgacgttggtggtataactatgtctcctgtaccaactagcaccnggacaaacgcccccaaatcatcgattannatgtcagtatcgcctcgagggttctaagtcgtacttcgtactcggcttccgaagttcnggacaacgcggcctcccgtagacctatcctcgtcggcctccgacggtctaggacggacgaggtctagacttatacngacagtctacatactaacagtcagacagtcactacaacgttcgtacggacttgggaccgaaggtccaccggtcctaggaccctaacgacccgtaaccggaccccaacccgtacgtactacccg

SEQ ID NO: 199259 - DNA, 517 bp, Homo sapiens
  misc_feature: GYAE6OF02HHFKG.18.59.F04.1.454.CMB.1.raw
  modified_base (196)..(196): a, c, t, g, unknown or other
  misc_feature (196)..(196): n is a, c, g, or t
  modified_base (312)..(312): a, c, t, g, unknown or other
  misc_feature (312)..(312): n is a, c, g, or t
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
  modified_base (479)..(479): a, c, t, g, unknown or other
  misc_feature (479)..(479): n is a, c, g, or t
  modified_base (504)..(504): a, c, t, g, unknown or other
  misc_feature (504)..(504): n is a, c, g, or t
  modified_base (512)..(514): a, c, t, g, unknown or other
  misc_feature (512)..(514): n is a, c, g, or t
  modified_base (516)..(517): a, c, t, g, unknown or other
  misc_feature (516)..(517): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaanagcacccaggcaaagcccccaaactcatgatttatgatgtcagtaatcggcctcgtaggggtttctaaatcgcttctctggctccaagtctggcaacacggcctccctgaccatcnctgggctcaggctgaggacgagctagattattacngcagctcaatatacaagcaaccagcactctctatcgtctacgaacgtggacaaggtcaccgtccgtagtcacgacccaacgccaacccactcgcactctcgttcccncccttcctcctactacctcttacgngacggcgggctcggacaaggccganacgtagcnnncnn

SEQ ID NO: 199260 - DNA, 707 bp, Homo sapiens
  misc_feature: GYAE6OF02HF1KZ.18.59.F04.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
tcagtacgagtatgcacgaccggtgctcgatttagtacacacacttagggattgggggggtcgtcaggaggcagcgctctcgggacgtctccaccatggcctgggctctgctatcctcaccctctcactcagggcacaggtcctgggcccagtctgccctgactcagcctgcctccgtgtctgggtctccgtaggacagtcgatccacactctctgcactggaaccagcagtgtacgttggtagttanaactntntctctggtacaatanccaccnggtacaaacgtaccccaaactcactgtattaactgattcgactaactaacgtccgtacctacgtacgggtttactaaacgtcgtaccgttcttcgtcggaccttcgtaacgttctacggactacgaaccggtcctccgtacgaccgtattcctcgttcgggccttaccgacgggtctacggtacgggacgtacggtacgtagtaacgtttataccgttcgaccgttacgtactacgtaattaaaccggtactaaaaccgccgaaacctaacggtcccaaccttaccgtcgttttaacctcgtttccggtttaaaccccgggaggttaaaccggggttaccctaaaccgggttaccgttaccccggtttaaccggtacggttaccaaccgggttaaccccaaccgggtacccccttaaaccccggtacccgg

SEQ ID NO: 199261 - DNA, 701 bp, Homo sapiens
  misc_feature: GYAE6OF02JOCFI.18.59.F04.1.454.CMB.1.raw
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctcgggtctcctggacagtcgatcaccntctcctgcactggaaccngcagtgacgttggtgttataactatntctctggtaccaanagccaccgagccaaacgccccaaactcatgtattangatgtcactagtccgcctcgtagggttactagtcgtcttctgtcggctacagtcgtcgaccacgaccggccctcctacgaccactcctcgtaggtcccctacgtacgggctacgggaacggaccgtacggggtacttacggtaattttaaacgtttccggacgttaccgaaccgggttcttaaccaacggtttaaacctaacccggtaaacggttaccccaacccgttaaacgggacccttaaccgttacctttaaccggttaacgttttccggttaacccggttttaacccggggtaacgttaaccggggtaaacccgttaaccggtttacccgtaccccgggttacgttaccgggtaacccgacccggtaaccccgaacccgggtaccccc

SEQ ID NO: 199262 - DNA, 786 bp, Homo sapiens
  misc_feature: GYAE6OF02I78KL.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (772)..(772): a, c, t, g, unknown or other
  misc_feature (772)..(772): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctggtaccaacagcaccgaggcaaacgcccccaaactccgaatgtactttatagatgtacagttaagtccggtacctcgtagggtttactaagtcgtcttcttacgtcggtcctccgaacgttcgtacggacctaaccgtacccgggtcccttaccccgtacgaacccgtaactttccgtaccgttcggggtacccttacccggacgggtaccgtacggggtaaacgggaaccggtacggggtaccttaacggttaacgttttaaccgtttaaccgttcgggtaccgtaaacgggttccttacgtaaactttaacgttaaacccgaaacgtaccgtaacggtaaccgtaccgtaaccgtaaccgttaacccgtaaacggtttccgtttaaccggggaaacggtttacccggggaaacccgttaaaccgggttacccgtaaccccgggttacccggttaagggttaaccccgaaccgggtaaccccccgtaaacgggaccccccgttaaacccccngggtttaacccccg

SEQ ID NO: 199263 - DNA, 683 bp, Homo sapiens
  misc_feature: GYAE6OF02HO9QV.18.59.F04.1.454.CMB.1.raw
  modified_base (214)..(214): a, c, t, g, unknown or other
  misc_feature (214)..(214): n is a, c, g, or t
  modified_base (291)..(291): a, c, t, g, unknown or other
  misc_feature (291)..(291): n is a, c, g, or t
  modified_base (372)..(372): a, c, t, g, unknown or other
  misc_feature (372)..(372): n is a, c, g, or t
  modified_base (444)..(444): a, c, t, g, unknown or other
  misc_feature (444)..(444): n is a, c, g, or t
  modified_base (488)..(488): a, c, t, g, unknown or other
  misc_feature (488)..(488): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctctcactcagggcacagggtcctgggcccagtctgccctgactcagcctgcctccgtgtcgtcgggtctccgtaggacagtcgatcaccntccgtccagcacgtggaccatcagggtacgttggtagtatactatgtctcgtagtaccatcgcaccaggacaaaccncccctaactcatacgattatgatgtacatacgtccgacctcgtaagggtttctaacgtctcttctccgtgtaccttaccgngttacgtggaacctaccgaccggtccccttcctcgaacctcgttcctcgttacgggcctccgggtacgccgnggtaacgggacggtacgtaccgttagtaacctttagtttaaccngaccggtacgtctaaccggtacttaacggttaaccaaccgtacgacccaaccgttttacaaaccggttctaccgttaacgttcgtaccgttaccgggtaaccggtaaccggtaccggtaacccggttcccgtacccggttacctaccgggtcccggaacggttaacccccgaaggacccccctaacccgttccgg

SEQ ID NO: 199264 - DNA, 550 bp, Homo sapiens
  misc_feature: GYAE6OF02FLDRK.18.59.F04.1.454.CMB.1.raw
  modified_base (229)..(229): a, c, t, g, unknown or other
  misc_feature (229)..(229): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgtttggtgttaataactatgtctcctgtaccaacagcaccaggcaaacgcccccaaactcatgatttatgatgtcactaatcggcctctagggttctaatcgtcttctctgctcagtctgacacgacgccacctgaccactctcgtcggtctccgaggtctggacggacgaggctagtacttatctcgcagtctacagtactaacaacgacacgacagccaactactaagttcctacggaactcgggaaccgtacggtaccaccggttacctaacggtacaccggacccgaaggacccccacccgactacccg

SEQ ID NO: 199265 - DNA, 562 bp, Homo sapiens
  misc_feature: GYAE6OF02GSODJ.18.59.F04.1.454.CMB.1.raw
  modified_base (304)..(304): a, c, t, g, unknown or other
  misc_feature (304)..(304): n is a, c, g, or t
  modified_base (458)..(458): a, c, t, g, unknown or other
  misc_feature (458)..(458): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctcctggtaccaacagcaccaggcaaacgcccccaaatcatgatttangatgtcactaacgtccggccctcgtacggggtttctaagttcgtcttctcgtcggctaccaagttctggaccaaccgacggtccctccctacgacctatcctcgtcgggcctccgaggtctaggaggacggaggtctagtatttatacgtgacngtctcatactacacgcacagctactctctatgttcgtacggaacgtgggaacctacggtcctaccgttccgtaggtccacggcccgaacggccctaacccgtcg

SEQ ID NO: 199266 - DNA, 750 bp, Homo sapiens
  misc_feature: GYAE6OF02HTUO9.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccagcagtgacgttggtgttatactatgtctctggtaccaacagcaccaggacaaacgaccccaaactcatcgtatttactgatgtactactaagtccggtaccctcgtacggggtttactaagtcctctttcctacgttcggtccttaccgtaacggttcgtacgggacctaaaccgacccgggtccccttacccgtccggtaaccctagttcccgttaccggttccgggggtcccttacccgggacgggtaccgttacggggaaacgggtaccgggtaacgggtccggttacgttaaacgttttacgttaccgttacgggaccaacgttccgttaacttaacgttaacgtaaaccgtaacggtaccctaaacccgacggtacctaaccctttctaccgtttacgttccggtttacccggtttaacgggtaaccgttaccggggaacccgttaacgggtacccgttacccgggttaccgtaccggttaccgaaccggttacccccgaacggtaacccccccg

SEQ ID NO: 199267 - DNA, 732 bp, Homo sapiens
  misc_feature: GYAE6OF02IUSXQ.18.59.F04.1.454.CMB.1.raw
  modified_base (313)..(313): a, c, t, g, unknown or other
  misc_feature (313)..(313): n is a, c, g, or t
  modified_base (532)..(532): a, c, t, g, unknown or other
  misc_feature (532)..(532): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctctcactcagggcacagggtcctgggcccagtctgccctgactcagcctgcctccgtgtctgggtctccgtggacagtcgatcaccatctcctgcactggaaccagcagtggacgttggtgttatactatgtctcctgtaccaacagacaccaggacaaaccgacccccaaactcatagtaacttttancgtaattcgtacaacgtaactccggtcctacgtaggggtttactaagtcgtccttctccgtaggtccctaccgtaagttccgtacggtaccaaaccgtccggtaccccgttccctacggtaccctacgttccgtacgtcggggtacccttaccggacgggtccgttagggtaaccggaacgggtacgggtaccgtacgtttaagtttaacgtttaccgnggtacctaggtacctacgtaataaccttaacgaaccgacccgtaacctaccggtacctaacccttaccgtacgttaccgtttacgttacccgtacggtaacccggttaacggggtaacccgaacgggttcccgtaaccggttaccgtaacgggttacccaaccgggtaaccccgaacccggtaaccccaccccggttacg

SEQ ID NO: 199268 - DNA, 565 bp, Homo sapiens
  misc_feature: GYAE6OF02HMJ4N.18.59.F04.1.454.CMB.1.raw
  modified_base (231)..(231): a, c, t, g, unknown or other
  misc_feature (231)..(231): n is a, c, g, or t
  modified_base (518)..(518): a, c, t, g, unknown or other
  misc_feature (518)..(518): n is a, c, g, or t
  modified_base (558)..(558): a, c, t, g, unknown or other
  misc_feature (558)..(558): n is a, c, g, or t
  modified_base (563)..(563): a, c, t, g, unknown or other
  misc_feature (563)..(563): n is a, c, g, or t
tcagtacgagtatgcacgaccggtgctcgatttagtacacacacttaggggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcactaatcggcctgtagggtttctaatcgcttctctggctccaatctggacaacaccggcctccctagaccatctactgggaccttccgaggtcctggaggacgaggctgattattactgcagtctcatatacaacgtcaccgagcacgttctctacttcgtaccgttacggaacgtcggaacctaagggtccaccgtactaggtcctacgacccaaggacccctaacccacgttcgtactaccttctcgttccccaccttcctccgtactccgtacgtacncgacggccggtctcggtacgaggccagacgtagcaccgtnacgtncg

SEQ ID NO: 199269 - DNA, 685 bp, Homo sapiens
  misc_feature: GYAE6OF02JZ1XA.18.59.F04.1.454.CMB.1.raw
  modified_base (326)..(326): a, c, t, g, unknown or other
  misc_feature (326)..(326): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctatttaaaggtgtcagtgtgagtgcagctggtgagtcgtgggggaggcttgggtaaaggccgggggggtcccttaggacctcccctgtacagcctctggacttctactttcgagtaaggcctggatgaactgggtccgccgaggcctccgagggagggcngggacggtgggtgccgtaataaaaccaaactggatgggtacggacaacgacgacgtacgcgtagccgacccggtagaaaggcgaagtacgtaccaccacttacctacaaacgagtacgtagtaacgttacgaaaaaacgcgaacgtcttaagtaacttcgtacgaactaatacgaacaagccctaggaaccgaaccgtaaggacccaacgacgggtaccgttagttaacttaccgttaacgtacccgtaaactacccgtaccgttacgaaacgttacccggaacctaaacttacccgaacttaaccgtacgtaacgtttaccgggaccttacgggacggtaccccggaaggtaccccgg

SEQ ID NO: 199270 - DNA, 820 bp, Homo sapiens
  misc_feature: GYAE6OF02ITULY.18.59.F04.1.454.CMB.1.raw
tcagtacgagtatgcacgaccggtgctcgatttagtacacacacttagggagtttgggggtctgggagagggacgccccgagccgttgggattcccaaagtgttttctacttcagtgatcaggactgaacacagaggactcaccatggagtttgggctgagctggtattttccttgctgcttaattttaaaaggtgtccagttgtgaggtgcagcgtggtggagtcgtgggggaggtcgttaggtaaacgggccgggggggttcccttacggaccttcccccgtagttaccgacggtcccttcgtcggtattcctacttttcaaggttaacggccttggatgaacgttgggtcccgccgtacggccgttccggaggggggaacggggcgttacgggtaggttggggttacggtaaccggttaaactttaaaaaacccgaaaacgttggtaacgttagggtacgggtaaacaaccgtaaggaaccgtaccggctacggaccgaacccggtaggaaacgacgagtactaccaactcgtactaacgaagagtattaacgaaattaaacgaaaaagcctaacgtcgttagtaactcgtaacgaataaactaaggaacctaacggcgtaagaaccgggaaaccggaagtaccgtaaacgaccgggttaccgttaacttaacgtttaccgaacgtttaaacccacgtaccccgttaaccgaacggtaaaccggtaccctaaccgtaaaccgttttaaacccgtaacgtttaaccgttaacggttaccgtttaccgggacccgtttacgggtccggggaaaccccgg

SEQ ID NO: 199271 - DNA, 574 bp, Homo sapiens
  misc_feature: GYAE6OF02ILV3K.18.59.F04.1.454.CMB.1.raw
  modified_base (202)..(202): a, c, t, g, unknown or other
  misc_feature (202)..(202): n is a, c, g, or t
  modified_base (354)..(354): a, c, t, g, unknown or other
  misc_feature (354)..(354): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctgccctgactcagcctgcctcgtgtctgggtctcctggacngtcgatcaccatctcctgcactggaaccagcagtgacgttggtagttataactatgtctcctggtaccaacagccaccagacaaaccgaccccaaactcatgtatttatgatgtcaactaacgtcggtccctcgtacgggtttactacgtcncttctctcggcctcgagtcgtgacaacgaccggccctccctcgacctatcctacgtcgggtcctccgacggtctaggacgggacggaggcttagtaatttacttcgtcgcagtctacatactaacgacaccaccagactaccgttctctatcgttacgtcggaacgtcggtaaccacggtaccgtaccgttacgtacgaccgacgacccgaacgaccccg

SEQ ID NO: 199272 - DNA, 875 bp, Homo sapiens
  misc_feature: GYAE6OF02JRGNO.18.59.F04.1.454.CMB.1.raw
  modified_base (280)..(280): a, c, t, g, unknown or other
  misc_feature (280)..(280): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgccctccgtgtccgtgggttctccgtggaccagtcgactccaccatcctcctgcactggaaccagcagtgacgttggtgtataactatcgtctcctggtaccaacanccaccgagacaaacgccccctaactcacgtgtatttagtgattacgtcaacgtaacgttcccggacccttaggttacgggtttactaacgtccgtactttcgtcgttccgactacccgtaagtttccgtacggacctaaccgacccgtaccccgttacccgtacgtaacccgtaacgtttcccgttaccgtaccgggtccctacccggtacgggtccgtaacggggtaacgggaaccgggtaacggtcccgttaaggttaaccttttaaacgtttccggttacgggaccgttaacggttaccttaaccgtaaacttaaccggtaaacccgtaaacggacccctaaacccgtaaccgtaccctttacccgttaaccgttaaccgttaaccggtttacggtttacccccggttttaaacccgggggtaaacccggtttcccgggggtaaaaccccgggttaaccggggttttaaaccccccgaccccccggggttttaacccgtttaacccggggggtaacccccgttaacccccggaaccccccggggtaaacccccgttaaccccccccgggttaaaccccccgttaaccccggg

SEQ ID NO: 199273 - DNA, 694 bp, Homo sapiens
  misc_feature: GYAE6OF02JDSXN.18.59.F04.1.454.CMB.1.raw
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttgtgtatactatgtctctggtaccaacngcaccaggcaacgaccccaatcatcgattangtatgtcactagtccgtcctcgtagggttcctaagtcgtacttctcgtcggctaccgtaacgtctcggacaacctaccggcccttaccccgtacgtaccctacttccgtacggtcgggtccctaccgacggtcgtacggacgggacggtacggtacgttaggtaactttacgttaccgtcgtacctaggtacccttactaagtttaacctaaaccgtaaccgacccgaaccgtaacggacccttaccgttaccttcggttacgtttacgttaccccggtttaacgggtaaccggttaaccgggaaacccggtaaccggtttacccggtaacccggtttacccggttaacggttaacccgacccgggtacccccgtaacccgggtaaaccccccc

SEQ ID NO: 199274 - DNA, 390 bp, Homo sapiens
  misc_feature: GYAE6OF02HO7TM.18.59.F04.1.454.CMB.1.raw
  modified_base (195)..(195): a, c, t, g, unknown or other
  misc_feature (195)..(195): n is a, c, g, or t
  modified_base (361)..(390): a, c, t, g, unknown or other
  misc_feature (361)..(390): n is a, c, g, or t
tcagtacgagtatgcacgaccggtgctcgatttagtacacacacttagggattgggggagagaagacaggattcaggacaatctccagcatggccggcttccctctcctcctcaccctcctcactcactgtgcagggtcctgggcccagtctgtgctgactcagcccaccctcagcgtcgtcgggacccccgggnaggagggtcacatctcttgttctaggagcagctaccaacagtcggaatcacgccgaaggcctccgccccctcggtacctactctccgttacccccaccccttcctacctactacctcggttactcggaggccggggtctcgggacgaacgggcaccgaagtaggcnnnnnnnnnnnnnnnnnnnnnnnnnnnnnn

SEQ ID NO: 199275 - DNA, 683 bp, Homo sapiens
  misc_feature: GYAE6OF02FSYOV.18.59.F04.1.454.CMB.1.raw
  modified_base (316)..(316): a, c, t, g, unknown or other
  misc_feature (316)..(316): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctgcccttgactcagcctgcctccgtgtctgggtctcctggacagtcgatcaccatcctcctgcactcggaaccagcagtgacgttggtgttataactatgtctcctggtaccaacagaccacccaggcaaacgcccccaaactcatgtatttacngattcgtacaactaactccggaccccttcgttaacggggtttacctaagtccggtaccttccgttcgtcggtacctaccgtaagttcgtacggaccgaaccgaccggtacccttccccgtagaccctacttctccgtgggtccctacccgtagccgtacggaaggaccggacggtcgttagtaacttttactacgttacggacacggtaccttacaacgttaactaacgtaacggaccctaaccgagttaacctaccgttactacttacgttacgtcgtttaacgggaaccgttaccgggaacgttacggttacccgacccggttaccgtaccggtacgacccggacccgtaaccggtaaccccccg

SEQ ID NO: 199276 - DNA, 670 bp, Homo sapiens
  misc_feature: GYAE6OF02HJCRA.18.59.F04.1.454.CMB.1.raw
  modified_base (202)..(202): a, c, t, g, unknown or other
  misc_feature (202)..(202): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
tcagtacgagtatgcacgaccggtgctcgatttagtacacacacttagggattggggggggtctcaggaggctagcgctctcgggacgtctccaccatggcctgggctctgcttattcctcgaccctcctcactcagggcacagggtcctgggcccagtctgccctgactcagcctgcctcgtgtctgggtcctcctggacngtcgatccgaccatctctgcactggaaccagcagtgacgttggtgttanaactntgtctctggtaccaacngccaccaggacaaacgcccccaaaactcatacgtatttagcgatcgtactactaacgtccggcccttaggtacgggttttactaacgttcgtcttctcgtcggtcctaccgtaaggtctcggaccaaacgtccggtccctaccgtcgacctatcctcggtcgctcgacgcgtaggacggacgtacggtctagtacgtttactacgtcgactcgtactacacttaacgtaacgaacgacgacgaccgacgtacctaaccgtaccgttaaacgttccggtaaccgggtaaccggtaccgggtaaacccgttacgggtaccctaaccccggttcggttaaccggaccgtaaccgggaacccccgttaaaccgggaccccctaacccggtaccttacccgg

SEQ ID NO: 199277 - DNA, 647 bp, Homo sapiens
  misc_feature: GYAE6OF02F4NAE.18.59.F04.1.454.CMB.1.raw
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
  modified_base (315)..(315): a, c, t, g, unknown or other
  misc_feature (315)..(315): n is a, c, g, or t
tcagtacgagtatgcacgaccggtgctcgatttagtacacacacttagggagttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacngtcgatcaccatctcctgcactggaaccagcagtgacggttgtggttataactatgtactcgtcgtaccaacncgccaccgaggccaaaccgccccaaactcatgtacttangtatagtacactaacgtccgccctcggtacgggttttacaacgtccgtcttcgtcgtcggtcctacgtaacgttcgacggtaccaaccgaccgtcccttcccagacctcgttctacgtcggcctcgaggtcgtaggtcgggaacgacggtctagtattttacgtaccgttgaccgtgaccttagtaacgtaactacgtacgaacctaccgaactaccctacgttaccttacgtacttcggttcccggttaacgggtaccgtacgggaaccgttaacggttcccgtacccggttacgtacgggtacctaccggtacccgaacggtaacccccc

SEQ ID NO: 199278 - DNA, 577 bp, Homo sapiens
  misc_feature: GYAE6OF02GVIK9.18.59.F04.1.454.CMB.1.raw
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttagggtaaaggccgggggggtcccttaggacctccccgtgtacacgcctctggattcactttcagtaaggcctggatgaactgggtccgccaggctccgaggggaagggctggagtgggtggaccgtaataaaccaaatgatggtggacaacagactacgctgccaccgtgaaacggcagatcaccntctacaaganatgaattacgaaaagcacgactgtactcgtagactaaatacgaacacgacctagacgaacgacgacacgacgccgtatacgtactacgtaccacactcccgtagaacgtcgtacaactactactacgtagtactcgtcctggacggtaccgacggtaccg

SEQ ID NO: 199279 - DNA, 566 bp, Homo sapiens
  misc_feature: GYAE6OF02JEDK9.18.59.F04.1.454.CMB.1.raw
  modified_base (304)..(304): a, c, t, g, unknown or other
  misc_feature (304)..(304): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcacccatggagtttgggctgagctggattttccttgctgctatttaaaggtgtccagtgtgaggtgcagctggtggagtctgggggagcttggtaaaggccggggggtccttaggactcccgtgtacagcctctggattcactttcagtaggcctggatgaactgggtccnccaggctcgagggagggctggagtggtgccgtataaacaactgatggtaggacaacgagactacgctagcaccgtagaaacgcaagacttcaccatctanaagagatagattacaaaagcaacgntagtatctacgacaaagtcgaacacgtcctaggaacgaaccggagaaccaacgacgaccgtagtaacgtactacgtaccacgtactccctagaacgtctacgaactacgtactaccgtacggtactacgacctcggg

SEQ ID NO: 199280 - DNA, 660 bp, Homo sapiens
  misc_feature: GYAE6OF02I43AK.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttaataactatgtctccgtggtaccaacacgcaccaggacaaacgcccccaaactcatgtatttatgtatcgtacactaacgtccggacccttcggtacgggtttacaacgtcgtccttcttcgtcgcctacctaacggttcgtacggccaaaccgaccggtccctcccgtacgacctactcctccgtcgggcctaccgacggtcgtaggtacgggacggacggcgtagtatttaacgttacgtcgactacgtcctactaactaataacgaacgtaccaaccaacggtacctaacgtccttacttacgttcgttaccgttacggtacggtaaccgggtaaccgtaacggtccgtaacccgtacgttaccggtaccgtaccggaccccgtaaccggacccccaacccctaacccgg

SEQ ID NO: 199281 - DNA, 661 bp, Homo sapiens
  misc_feature: GYAE6OF02JOAXE.18.59.F04.1.454.CMB.1.raw
  modified_base (206)..(206): a, c, t, g, unknown or other
  misc_feature (206)..(206): n is a, c, g, or t
  modified_base (322)..(322): a, c, t, g, unknown or other
  misc_feature (322)..(322): n is a, c, g, or t
tcagtacgagtatgcacgaccggtgctcgatttagtacacacacttagggattggggaggagagacccctcccctgggatcctcgggcccagtctgccctgactcagcctgcctccgtgtctgggtctcctggacagtcgatcaccatctcctgcactggaaccagcagtgacgttggtggttataactatgtctctagtaccaanagcacccaggcaaacgccccaaaatcgatgtatttatgattgtcaacgtatccggcctcgtaggggtttactaatcgtcttctctggcctcagtctggacacgcgcctcctgaccntctcgtcggcctcgagcgtaggacggacggtacgcgtagtaacgtttaacgttccgtgacgttaacggtccttacgtaaactacgtaaaccgaacgcctaaaccgacgtacctaaccgttctacgttagtcggttaccgtacggtaacgtcgggaaacctacggtccgtaccgtaccgttacgccgaacgtacccaccggacccctaaacccgtcgttaccgtcctaccttacccggtccttaccccgtacccttacctacctacgttaccttaccggttaccggtacggaacggttcgggaaccgttcgaaggaccgtacgcgtacgaactgctaacg

SEQ ID NO: 199282 - DNA, 746 bp, Homo sapiens
  misc_feature: GYAE6OF02FZWXK.18.59.F04.1.454.CMB.1.raw
  modified_base (229)..(229): a, c, t, g, unknown or other
  misc_feature (229)..(229): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcacgccaccctcagcgtcgtcggggacccccgggcaggagggtccaccatcctcctgcacgtggggacnccacctccaacacgtcggggcggttatgatgtacacgtacgtaccagactaacttccgaaggtaacaccgaccccctaaatttcgactactctaagtacggtaaacaagtaaccgtccggaccctacggtaccggggtaccctcggaccgttacttccgtcgtacggtcctaccgtaacgtccgtacgacctacccgtcgaccgttccctccgtccggacctaccgtaccgtacggttccgggaccgttaccgacgggtacggtacgggaacgggtacggtaacgggtcttaggtaactttaaccgtacggtcggtacctagtccgtaacttaactaacgtaccaaccgtaccaaccgtacgtacctaccttcgttaccttaacgtttccgtaaccggttaaccggtaaccggtacgggtaccctaacgggtacccgttacccggtacgtaacggtaccaaccggtaccccgtaacggtaacccctaaaccccgtgtccctaaccgtcccttcccgg

SEQ ID NO: 199283 - DNA, 653 bp, Homo sapiens
  misc_feature: GYAE6OF02IZU8E.18.59.F04.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (569)..(569): a, c, t, g, unknown or other
  misc_feature (569)..(569): n is a, c, g, or t
tcagtacgagtatgcacgaccggtgctcgatttagtacacacacttagggagttggggggggtctcaggaggcagcgctcgtcgggacgtctccaccatggcctgggctctgctattcctcaccctctcactcaggcacagggtcctgggcccaggtctgcctgactcgagcctgcctccgtgtctgggtctctggacngtcgatcaccntcctcngcatggaaccngcagtgtacgttggtgttanaactntgtctcctgtacacacgcaccagaccaaacgacccccaaatcctaatcgtatttactgagtcgtactaacgtaacttacccggaccccttgtaacggggttttcctaaacgttcgtcctttcgtcgtacgggtctacccgttaagttcgttacggccgtaaaccaccggtaccctcccgttagaaccctaacgttctccgtcgggccttaccgtaacggtcgttacggacgggtaaccggtagggtaccgttaggtaactttttaccgtaacgtttcgaaccgtcgccttactacgtataaccgtaaagccaaacgngcctacttacgtctacgtacttacgacgtacgtcggaacctaggtcctccggtaatccgtcaccgtccacgtacctaccctacg

SEQ ID NO: 199284 - DNA, 584 bp, Homo sapiens
  misc_feature: GYAE6OF02H6OZ5.18.59.F04.1.454.CMB.1.raw
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (488)..(488): a, c, t, g, unknown or other
  misc_feature (488)..(488): n is a, c, g, or t
  modified_base (578)..(578): a, c, t, g, unknown or other
  misc_feature (578)..(578): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacagggtccctgggccccagtctgccctgacctcagcctgcctccgtgtcctgggtcctcctggacagtcgatcaccatctcctgcacgtacggaccagcagtgtacgttggtagtaatactatgtcctcctggtaaccaacacgccaccgagacaaccgaccccaaatcagtntatttangtatgtacagtaactcggccctacggtagggttactacgtcgtcttctcgtcgctactacgtcgcgtacacgtacgcctccacgtaccactctcgtcggctacgcgcgtgacggcgagtctagtacttagtacgtcgctagtctacgataacgtaagacgacaagcgaacnctactacgtacgttaccgtacgaccggtacggaacgtaacgtacgtaaccgtacgtcggacacccgaaccgacccggaaccctacccgtntaccgg

SEQ ID NO: 199285 - DNA, 760 bp, Homo sapiens
  misc_feature: GYAE6OF02HRMRM.18.59.F04.1.454.CMB.1.raw
  modified_base (203)..(203): a, c, t, g, unknown or other
  misc_feature (203)..(203): n is a, c, g, or t
  modified_base (408)..(408): a, c, t, g, unknown or other
  misc_feature (408)..(408): n is a, c, g, or t
  modified_base (472)..(472): a, c, t, g, unknown or other
  misc_feature (472)..(472): n is a, c, g, or t
  modified_base (526)..(526): a, c, t, g, unknown or other
  misc_feature (526)..(526): n is a, c, g, or t
tcagtacgagtatgcacgaccggtgctcgatttagtacacacacttagggattggggggaggaggagccccagccttgggattcccaagtgttttcattcagtgatcaggactgaacacagaggactcaccatggagtttgggctgagctggattttcctgctgctagttttaaaaggtgtcagtgtgaggtgcagctggtgngtcgtgggggaggcgttaggtaaaggccggggggtaccttacgaccgtccctgtaacacgcctcgtaggacttcgtacttttcgaacgtaacggcctaggatggtaaactcggggtcctaccggaggtcctaccggaaggggtaacggggctagggtaggtgggtacggaccggttaaacttaaaaccgaaaacgtgaattgggnggaacaagacgactaacgctcgacaccggtagaaggcaacggtacttaccgacaacgtcctaanaagacgtagttgaacttaaacgaaaaacgtacccgaacgtagtacgttaacttntacgtaaacgaaagttaacgaaacgacgaccgttaagaagtaacccggaaggaacaaccgacgttaccgtagtaactaccgttagaaccccaagtacctaacccctaagggtaccgtaaccggttaacctaaaacttacccggttaaactttaaacccggttaatacccgggtttaacggtaccccgttaaccgggggtacccggtaacggggtaacccggtaaacccccgggg

SEQ ID NO: 199286 - DNA, 514 bp, Homo sapiens
  misc_feature: GYAE6OF02FIWSO.18.59.F04.1.454.CMB.1.raw
  modified_base (296)..(296): a, c, t, g, unknown or other
  misc_feature (296)..(296): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
  modified_base (489)..(489): a, c, t, g, unknown or other
  misc_feature (489)..(489): n is a, c, g, or t
  modified_base (508)..(509): a, c, t, g, unknown or other
  misc_feature (508)..(509): n is a, c, g, or t
  modified_base (511)..(512): a, c, t, g, unknown or other
  misc_feature (511)..(512): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgtatttatgatgtcagtaacgtcggccctcgtaggggtttctaatcgcttctctggctcaagtctgcaacncgcctccctgaccatctctgggctccaggctgaggacgaggtctggtattattactgcagctcatatacaagcaccagcactctactatgtctacggacgtcgggaccaaggtcaccgtctacggtcacgcccaacgcccaacccncgtctcactcctcgttcccaccctccnccactctctctgcgcggtcncggacacggcgatcacgcnngnngc

SEQ ID NO: 199287 - DNA, 536 bp, Homo sapiens
  misc_feature: GYAE6OF02H35P9.18.59.F04.1.454.CMB.1.raw
  modified_base (188)..(188): a, c, t, g, unknown or other
  misc_feature (188)..(188): n is a, c, g, or t
  modified_base (331)..(331): a, c, t, g, unknown or other
  misc_feature (331)..(331): n is a, c, g, or t
  modified_base (411)..(411): a, c, t, g, unknown or other
  misc_feature (411)..(411): n is a, c, g, or t
  modified_base (461)..(461): a, c, t, g, unknown or other
  misc_feature (461)..(461): n is a, c, g, or t
  modified_base (512)..(514): a, c, t, g, unknown or other
  misc_feature (512)..(514): n is a, c, g, or t
  modified_base (516)..(517): a, c, t, g, unknown or other
  misc_feature (516)..(517): n is a, c, g, or t
  modified_base (519)..(522): a, c, t, g, unknown or other
  misc_feature (519)..(522): n is a, c, g, or t
  modified_base (524)..(529): a, c, t, g, unknown or other
  misc_feature (524)..(529): n is a, c, g, or t
  modified_base (531)..(536): a, c, t, g, unknown or other
  misc_feature (531)..(536): n is a, c, g, or t
tcagtacgagtatgcacgaccggtgctcgatttagtacacacacttagggattgggggctttgtctgggtctcctggacagtcgatcaccatctcctgcactggaaccagcagtgacgtttggtggttataactatgtctcctggtaccaacagcacccaggcaaacgcccccaaactcatgatttangatgtcactaatccggccctcgaggggtttcaatcgcttctctggctccaagtctggacaacaccggcctccctgaaccatctctggctccgagcctgaggacgagctagatttactactgcagctcatataacaacgcaccngcctactctctatgtcgttacggaactgggacccaaggtcacccgtctaggtcacgacccgaacggacccaaacccctancgtactaccgtctacgttccccacccttcctccaattaccgtcgttaccnggacggtccggggactacgggacctaaagggcccggacaacgttagcacgnnnannannnnannnnnncnnnnnn

SEQ ID NO: 199288 - DNA, 669 bp, Homo sapiens
  misc_feature: GYAE6OF02G6Y4Q.18.59.F04.1.454.CMB.1.raw
  modified_base (660)..(660): a, c, t, g, unknown or other
  misc_feature (660)..(660): n is a, c, g, or t
  modified_base (666)..(666): a, c, t, g, unknown or other
  misc_feature (666)..(666): n is a, c, g, or t
tcagtacgagtatgcacgaccggtgctcgatttagtacacacacttagggagttgggggctttgcctgggtcctgggcccagtctgccctgactcagcctgcctccgtgtctgggtctcctggacagtcgatcaccatcgtcctgcactggaaccagcagtgtacgttggtggttataactatgtctcctggtaccaacagcaccaggcaaacgcccccaaactcatcgtattatgatgtcactacgtcggcctgagggttctaatcgcttctctcggactaccaagtctggaccaacgaccggcctccgtcgacctacgtcctacgtcgggcctaccgaggtcgtggaacgggtacgacggtcgtagtatttacgttctcgtacgtacgtctactaagttaactaacgaacgaccaaccgacgtaccctaacgttcctacgttactacggtttaccgttaccggtaaaccgtacggggaaacctaacggtcccgtacccgttaccgtacggttaccgtaccggtacccgtacggaccccacctacgttccgtaccaccgttcctaccgttcccgtccctaccgtacctacgttaccgtacgtacgtacggtcggtaccgggtcgtaccggacgacggtacgacgtacggagtcgtacgngtacgntcg

SEQ ID NO: 199289 - DNA, 586 bp, Homo sapiens
  misc_feature: GYAE6OF02F56I6.18.59.F04.1.454.CMB.1.raw
  modified_base (385)..(385): a, c, t, g, unknown or other
  misc_feature (385)..(385): n is a, c, g, or t
  modified_base (411)..(411): a, c, t, g, unknown or other
  misc_feature (411)..(411): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccaacagtgacgtttggtggttataactatcgtctcctggtaccaacagccacccaggccaaacgccccccaaactccatcgatttatgatgtcactaatccggccctcaggggtttactaagtcgtcttctcgtggctaccagtctgacacacgcctccncgactatctcgtgctccgagtctagngacggagctgtattattacgtgcacgtctactatataaccgagccgtaaccacgtccacttcctacttaacttcgttaccgttaccggtaacgtacgggtaacccgtaacggtacccgtaccgttaccgtacggtccgtacgaccccgtaacgcccccgtaaccgccgttaaccg

SEQ ID NO: 199290 - DNA, 670 bp, Homo sapiens
  misc_feature: GYAE6OF02G3VLW.18.59.F04.1.454.CMB.1.raw
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgtacgttggtggttaataactntgtctctggtaccaacagcaccaggacaaacgcccccaaactcatcgatttagtagagttcgtactaacgtaacgtccggtccccgttcgtaacgggggttttacctaaacgttccgtctttcctaccgttcgggtccttaccgtaaaggttccgttacggaccaaaccgacccggtaccccttacccgtacggtaaccctacgttcctccgtcgggcccttaccgacggtcgtaggacgggacgtaggtcctagtatttagtacgtcgactagtcctactaattactaacgacgaccaaccgacgacctaacttacctacttacgtcgttacgttacggaacggtcggaaccgtaccgggtaccacccgttaccgtacgtaccgtaccgtacccggaacgtcccaaccccgtcg

SEQ ID NO: 199291 - DNA, 927 bp, Homo sapiens
  misc_feature: GYAE6OF02FV85X.18.59.F04.1.454.CMB.1.raw
  modified_base (139)..(139): a, c, t, g, unknown or other
  misc_feature (139)..(139): n is a, c, g, or t
tcagtacgagtatgcacgaccggtgctcgatttagtacacacacttagggattggggagctctgggagaggagccccaaccttgggattcccaagtgttttcattcagtgatcaggactgaacacagaggactcaccanggagtttggctgagctggattttcctgctgctatttaaagtgtccagtgtgaggtgcagctggtggagtcgtgggggagtcgttagggtaaacggtcccgggggggtacccttaggacctcccccgttaggtaccacggtccctcgtcggtatttcctaacgttttccgaaggttaaacggtcccgttagggtaacttacggtaaaccggttccgggggttaccccgaccccggtaacgggtcccgttaccccgggaaggggggaaacgggggtccgttaggggggtaacgggtttacggggggtttacggggtaacccggtttaaaacgtttaaaaaaaccccgtaaaaaccggtttcggtaaaggtttacgggggttaacggggaaccgtaaaacgtaacggtaacccgttaaccggaccgttacggaacccgtaaccccgggttaagggaaaacggggacctaaacggttaacgttttacccgaacccgttaacttacccttaacggaacgaaacgtacgttaggtaaactttaaccgaaaaaacggtcccgaaacggtcgttaagtaacttcgttaacggaactaaaagtacgaaaccgacggtacctaaggaacggtaaacccgaaggaacccgaacgaccgtaccggtaagttaacgtttaccgtacgtaaccctaccgtaccgttaccccgttaaaggaaccgttacgtaacccgttaactaacccgttaccgttaaccgttaaccggttaagtcccggtaaccgttccggtaaccggggg

SEQ ID NO: 199292 - DNA, 628 bp, Homo sapiens
  misc_feature: GYAE6OF02F4OWE.18.59.F04.1.454.CMB.1.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
  modified_base (621)..(621): a, c, t, g, unknown or other
  misc_feature (621)..(621): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgccctgactcacgcctgcctccgtgtcctgggtctctggacagtcgatcaccatctcctgcactgaaccngcagtgacgttggtgttaataactatgtctcngtaccaanagacaccaggacaagccccaaatcatgattangatgtcactaatcggcctcgagggtttcaatcgtcttctcgtcggctcctaaagtctaggtacaaaccgacggtcccttcccgtcgaaccactacgtccgtcgggccttacccgaggtcctaggtaacggaacggtagggtcctagggtaacttttaagttacctgcctaagccttacgaataacttacaaagcccgaaccaacggtctaaccgttctacttaagtcggttacctttacgggaactacggggtaaacccaaggttacccgaaccggttacttaacgggtaccgtaacggacccccttaaacgggcccctaaaccccgngttaacc

SEQ ID NO: 199293 - DNA, 776 bp, Homo sapiens
  misc_feature: GYAE6OF02GFLOK.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtgggggaggtcgttagggtaaacgggcccgggggggttcccttaggaccgttccccgtagtaccacgccttctggtacttctactttcgaaggtaaggcctaggtataggtaacgtcgggtcccgacgtacggcctaccggagggggaaggggtcgtagggtaggtgggggtttacggacccgttaaaacttaaaaaacccgaaacgtggaacgtgggtacgggaaccaaacgagtaacgtacgcgtcgaccgacccggtagaaacgctacgacttacacctatacctacgaaagtacgatagaagttaaaccaaaaacgccgtaccggtacttaggttaccttccgtaacgaactaaaagacgaaacccgtacggtacccgtaaggaaaccggaaccgtaacgggaaaccctacggtaacgtacccggtaagtttaaccttaacgtacccgtaaccaacgtacccgttacccgaaggtaaacccgtccgttaacctaaaccgtttacccgtaaaccgttaaccggttaacggtaaccgttaccggtacgttacccgggg

SEQ ID NO: 199294 - DNA, 820 bp, Homo sapiens
  misc_feature: GYAE6OF02HY4DL.18.59.F04.1.454.CMB.1.raw
  modified_base (815)..(816): a, c, t, g, unknown or other
  misc_feature (815)..(816): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgacccccaaactcatgatttatgatcgtacacttaagtccggcccttcgtacgggggttttctaaagttccgtcctttacgtctgggtccttaccgaaacgttcgtacgggaacctaaccgtaccggggtaccccttaccccgtcggaaccctaacgttcctccggttcggtccctccgaacgggtccgttacggacgggtaacggacggggtccttaggtaattttaacgtttaacgttcggaccgtaacggtcctactaaacttaagtaaacctaaacggaccaaacccgtaacgtacctaaccgtttcctaacctttaggtttaccgttaccggttttaaacccgggtaaaccgtaacggggtaaaccccgtaaacgggttaccctaaccccgggttaccgtttaacggtacccggtaacggaccccgtaaacccggtaccccctaaaaccccgtacgttccggtaaccctacccgttaccgttacccgttacccccctacccttacccgtacccttaaacttacccgttaccgtacttacgggacggttccggggactaccgggtaccgaacgggccctacgtacgtaggaccgtatcnntacg

SEQ ID NO: 199295 - DNA, 775 bp, Homo sapiens
  misc_feature: GYAE6OF02J2MLT.18.59.F04.1.454.CMB.1.raw
  modified_base (181)..(181): a, c, t, g, unknown or other
  misc_feature (181)..(181): n is a, c, g, or t
  modified_base (737)..(737): a, c, t, g, unknown or other
  misc_feature (737)..(737): n is a, c, g, or t
tcagtacgagtatgcacgaccggtgctcgatttagtacacacacttaggattggggagctctgggagaggagcccacgccttgggattcccaagtgttttcattcagtgatcaggactgaacacagaggactcaccatggagtttgggctgagctggattttcctgctgctattttaaagngtcagtgtgaggtgcagctggtggagtcgtgggggaggcttgggtaaaggcccgggggggttcccttaggaccgttccccctagttaccgacggtcccgttcgtcgggtaatttcctaccgttttaccaacggttaaacgggccctagggtacgtaggaaccgttcggggtcccgccctaacgggccctccgaacggggtaacggggcttggggaaggttcggggtttggggacccgtttaaacgttaaaaaaccccgaaaaaccgtttcggagtacggggttaggggaaacctaaacggaacgtaaacgtcggtaccgttacggacccaaccccgggttaggaaaaacggggctaaggtaactttcccgaaacccgtaattccccaagaacggaagagtaaccggtaattaccgaaaaaagttcccgacgtacctaggtactcgtagacaaacgtagtaaaccaggccctaagacgtaaaccggacgaaactacgaacgtcccggtataacttacctacgtacctacctaaccgtccctacgaaagtcccgtaanaccgttacaccgtacgtacggtactcggtaccctacgg

SEQ ID NO: 199296 - DNA, 786 bp, Homo sapiens
  misc_feature: GYAE6OF02FFUB9.18.59.F04.1.454.CMB.1.raw
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (775)..(775): a, c, t, g, unknown or other
  misc_feature (775)..(775): n is a, c, g, or t
  modified_base (782)..(782): a, c, t, g, unknown or other
  misc_feature (782)..(782): n is a, c, g, or t
tcagtacgagtatgcacgaccggtgctcgatttagtacacacacttagggattggggagagacgacccctccctgggatccgtgggcccagtctcgccctgactcagcctgcctccgtgtctggtcctccgtggacagtcgactccacctatccgtcctagacctacgtacggaaccagccgtaaggtcgttacgttggtacgttactaactgtcgtacctcgtacgaccaacgcgaccaccagtaccaaccnccctaancgtatagtacttacgagtctactactactacgtccgcgtaccgtaggtagttcctacgtctcttcgcgtcgacctacncggtacacgacnccgtccgcctacgtcacgtcgtcgtacncggtactacgngtacggagtacggtacgtntaacttacgttaaacgttcgtaacgaccgttaccgacgtaacgtaaacgttaaacccgaacgacggtaaccacgtaacccgtaaccggtaaccctaaccggtttaaccggtaaccggtttaaaccgggttaacccggtaaccgggtaacccgggttaaccggtaacccggttaacccggttaccggtacccgttaaccggttaacccggaacccggtaaccccgtaacccgggtacccctaaccgtaacccgttcgttacccgtcccgtttacccttacccgttaccccgtaaccctccgtacctaacgtacccgttacgaccggtacggacccggtacggaccggtaccgacgaaccgcgtaacgngactcgntatc

SEQ ID NO: 199297 - DNA, 859 bp, Homo sapiens
  misc_feature: GYAE6OF02HCOHT.18.59.F04.1.454.CMB.1.raw
  modified_base (160)..(160): a, c, t, g, unknown or other
  misc_feature (160)..(160): n is a, c, g, or t
  modified_base (168)..(168): a, c, t, g, unknown or other
  misc_feature (168)..(168): n is a, c, g, or t
  modified_base (172)..(172): a, c, t, g, unknown or other
  misc_feature (172)..(172): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtccncgtcagcncgcncgctccgtcgtctcggtcgtcctcggacgacgtgtctactaccactactcctcgtcgacctacggaacgaaccgacgacgtacggtacggttacgggttgggttaacgttaaactaacttgtcggttcccttcggttaccgtaaaccaacgaccgaaccccaaccggacggaaaccaaccccccgaaacccctaactacctagtagtttaatttacgagtacgttcgtaaccttaaacgtaaccggtcccgtacccgttaacggggtttaccggtttaactaacgtccgttccttcctcggtcgtaccctaacgtacgttcggtacgaaccgaaaccggtcccgtccccttacgaccgaacctttacttcctacggggccgttaccctacggggaccgttcggaggggaaccgaacgggtcgtacgttaagtttaactttaaccgttcggaccgtaggtaccttactaactaagtttaaacccaaacgggtaaccaacccaaccgggtacctaacccgttacttcttaaacgtttacggtttcccgttaccgggttaaacccgggtaacggggtaaccccgggttaaaaccggtcggtaacccccgttacccggtttaaaccgtaccggggtaacccgaacccccggaaacccgggtaacccgtaacccccccctaaccgttaccgg

SEQ ID NO: 199298 - DNA, 684 bp, Homo sapiens
  misc_feature: GYAE6OF02FSZ0C.18.59.F04.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgccccccaaatcatgatttangatgtcactaactccggcctcgtagggtttctaatcgtcttctctcggctaccgaagtctacggcaaccgaccggtcccttcccgtacgaccacgttcctacgtcgggcctaccgaggtccgtaggacgggaccggaggtctaggtaactttacgttacgtcgaccgtagtcctacgtaacttaacgtaaccaacggacctaaccgtacgaaccctaaccttaccgttactacgttccggttaccgtttaaccggggtaaccgttaccgggggtaaacccgttaagggttacccccgtaacccggtttacccggttaagggttcccgaaaccgggacccccgtaaaccgggacccccctaaacccccgttaacccgg

SEQ ID NO: 199299 - DNA, 708 bp, Homo sapiens
  misc_feature: GYAE6OF02HNXM8.18.59.F04.1.454.CMB.1.raw
  modified_base (337)..(337): a, c, t, g, unknown or other
  misc_feature (337)..(337): n is a, c, g, or t
  modified_base (692)..(692): a, c, t, g, unknown or other
  misc_feature (692)..(692): n is a, c, g, or t
  modified_base (704)..(704): a, c, t, g, unknown or other
  misc_feature (704)..(704): n is a, c, g, or t
tcagtacgagtatgcacgaccggtgctcgatttagtacacacacttagggtattgggggctttgcctgggtcctgggcccagtctgccctgactcagcctgcctccgtgtctgggtctcctggacagtcgatccacatctcctgcactggaccagcagtgacgttggtgttataactatgtctcctggtaccaacagcaccaggacaaacgcccccaaatcatgatttatgatagtcactaatcggtcctcgtagggtttacaatcgcttctctggctccaagtctggacctaacgaccggcctccctgaccctatcctactgggctcccgaggtcngtacggacgaggctacggtattactacgtgctaggctacaattactaaccgtaagtaccaaccaggtaccctacgttacctacggtttaacctacgtttaccggtttaacccgggtaaacgttacggggtaacccgtaaacgggttcccaaccccggttttccggtaacggtaccttaaaccgggcccctaaaaccgggtacccccaaaccccgttaccttacggtaccctaaccgttcgttacccggtttccccctacccgtttacccgtaccccgtaaacgttaccgttaccggtaacctacgtaccggtaccgggtcgaccggtacgtaaaccggcgaccgtacgttaccgntacgtaccgatntacg

SEQ ID NO: 199300 - DNA, 726 bp, Homo sapiens
  misc_feature: GYAE6OF02IXDNN.18.59.F04.1.454.CMB.1.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacacgggtcctgggcccagtctgccctgactcagcctgcctccgtgtctgggtctcctggacagtcgatcaccatctcctgcactcggaaccagcagtcgacgttgggtggttataactntgtctcctggtaccaacncgccaccgagaccaaacgacccccaaactacatagtatttagtgatcgtacacttaacgtccgacccttcggtacgggttactacgtcgtcttcgttcgtgtccctacgtacgttcgtcggtaaccaaccgtacccggtccctaccccgtacgtacccttacgttcgttcccggttacgggtccctccggtaacgggtccgtaggggtaaaccgggtaccggaacgggttcgttaacggttacttttaacgttttaacccgtcggtacctaacgtccttaaaccaacgtttaaactaacccgaaacgtacccaaccgtacgtacccgtaccttaccgttacttacgttcgttaccggttacggtaaccggttacgggtaaccgtacggtccgtacccgtttacgtaccggtcgtaaacccgacccggtaaccgtaccccgacccgttaacg

SEQ ID NO: 199301 - DNA, 532 bp, Homo sapiens
  misc_feature: GYAE6OF02H4LQM.18.59.F04.1.454.CMB.1.raw
  modified_base (435)..(435): a, c, t, g, unknown or other
  misc_feature (435)..(435): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcatggaaccagcagtgacgttggtggttataactatgtctcctggtaccaacagcacccaggcaaacgccccaaactcatgattatgatgtacagtaatcggtcctcgaggggtttactaagtcgcttctctggctcaagtctggacaacacggccctccctgacctatctcgtcgggctccaggctggacggcgaggctgtaattattactgcngctacatataacaagcagcagcactacaagtcttacggaactacgggaaccaaggttccaaccggtctaggtccacggccaacggccctaaaccccg

SEQ ID NO: 199302 - DNA, 799 bp, Homo sapiens
  misc_feature: GYAE6OF02I4V9U.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttcctgctgctatttaaaggtgtccagtgtgaggtgcagctggtggagtcggtgggggaggtcgttagggaaacgggtccggggggtcccttagacctccccgtgtacacgcctcgtaggtacttcctactttcgaacgtaacggccgtaggactcgaacgtcgggtcccgcgacggccgtaccggaggggtaagggcgtagggtacgggttggggttcggtaccggttaaacgtttaaaaacccgaaaacgttcggaaggttcggggtaacggggaaccaaacggtacggaaccgtacggacgtacgacccgtaacccggtaaggaaaacggcgtaacggtaacttacccgaaccgtacgtccgtaacgaaaggtacgtaacgtacgtaaacgttaaacgaaaaaacgccgtaaccgtacgttaacggtactactaacggaacttaaaagtacgaaaccgtacggaccgtacggaaaaccgtaaccgacggaaaccaacgtaccggtaccgttaagtacttaaccgtaacctaccgaactacccgttaccggtaacgtaaaccggccttaaccgtaacctttaccgaaccgttacgtaaccggtaccgtacggtaacccgtaccggtaccgggtaacccg

SEQ ID NO: 199303 - DNA, 599 bp, Homo sapiens
  misc_feature: GYAE6OF02HS5L2.18.59.F04.1.454.CMB.1.raw
  modified_base (313)..(313): a, c, t, g, unknown or other
  misc_feature (313)..(313): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtcctcgtgtaaccaacagacaccgaggacaaaccgaccccaaactcatagatttangtatgtactactaactccgacctgtagggtttacaagtcctcttctcgtacggtctacaagttcgacgacaaacgaccggtccctaccgacgacctatcctcgtacggtcctaccgaggtctaggacggacgaggctagtaattactacgtgacagctacaattaacaacgaacgccaacgaacgtaccaacttcctatacgtcggttaccgttaacggaacgttcgggaaacctaacggttccacccggttcgtacggtacaaccggacccgaaccgtaaccccg

SEQ ID NO: 199304 - DNA, 694 bp, Homo sapiens
  misc_feature: GYAE6OF02FSE9X.18.59.F04.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatcctcctgccactggaaccngcagtgtacgttggtgttataactntgtctctggtaccacagcacccaggcaacgcccccaaatcatgtatttatgatgtcactaacgtccgcccttgtagggtttactaatcgtcttcgtctcggctaccgaagtctggacctaacaccggtccctcccgtcgaccacttccgtccgttcggtccctccgaggtcgtaggacgggaccggtaggtccgtaggtaactttagtaccgttgcgacgtacctacgtaattaaactaccgtaaacgccctaaccgacgtacctaccctttccgttacttacgtttacgttaccggttaaccgggtaaaccgtttaaccggggtaaaccccggtaaccgggttaccccgtttaaccgggtttaccccgttaacgggttaacccgtaacccggggaacccccgtaaaccggggtacccccctaacccccgttaacccgg

SEQ ID NO: 199305 - DNA, 776 bp, Homo sapiens
  misc_feature: GYAE6OF02ITGOU.18.59.F04.1.454.CMB.1.raw
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (417)..(417): a, c, t, g, unknown or other
  misc_feature (417)..(417): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcaggcacagggtcctgggcccagtctgccctgactcagcctgcctccgtgtctggtctccgtggacagtcgatcaccntctcctgcactcggaaccngcagtgacggttggtagttntaacttgtctctgaacacngccaccgagacaaccgaccccaaactcatgtattagngntacgtactaacgtacgtcccgcctaggttagggtttacttaacgtcgtccttcgtcgtacgtctaccgtaagtcgtacggacaaccgcccgtcccttaccctcgtaaccctntccgttccggtccgggtaccctccggtaacggtccgtaagggacggggtaaccggtacgggtaccttaacgggttaacttttaacgtaccgttacgccgttaaccggtccttaaccgttaacttacctaaaccgaaccgaaccccgtaaaacccggtacctaacccggttaaccctttcggttaacccgttacgttttcccgggttaaccggttttaacccggggaaccggtttaaccgggggttaacccccggttaaccgggtaccccttaacccgggtttacccgttaacccgggtaccgtaaacccccgttaacccccgggtaacccgtaacccccccggttaccccgttaacccg

SEQ ID NO: 199306 - DNA, 784 bp, Homo sapiens
  misc_feature: GYAE6OF02F7LCY.18.59.F04.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctcgccctgactcagcctgcctccgtgtctgggtctcctggacagtcgatcaccatctcctgcactggaaccngcagtgacgttggtagtatactntgtctcctggtaccaacagcaccgagacaaacgccccaaactcatgactttangatgtacagtaactccggccctagtagggtttacagtccgtcttctcgtgctccaagtcnggacaacgccgccctccgtcgacctacttccgtcgtcgggcctaccgagggtcgtacggaacgggtaccggaggtacgttagtaacgttttaacgttacgtacgggtacccgtaaacgtccgtaacctaaggtttaactaaaccggaaccggtacaacggtaccgtaaccgtacccgttaaaccggtacccgttaaacggggtttacccgttacggggtaaacccggtttaacccgggggttaaaccccggttaaaaccgggggtttacccccgttaaccccgggtttaaaccccggggtttaaacccgggtttaaccccgggtaaaaccccccggggaacccccccgggttaaaaaccccggggggaaccccccccttaaaaacccccccgggttaccccggtttaaaccccccggg

SEQ ID NO: 199307 - DNA, 604 bp, Homo sapiens
  misc_feature: GYAE6OF02G0NGN.18.59.F04.1.454.CMB.1.raw
  modified_base (576)..(577): a, c, t, g, unknown or other
  misc_feature (576)..(577): n is a, c, g, or t
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (583)..(587): a, c, t, g, unknown or other
  misc_feature (583)..(587): n is a, c, g, or t
  modified_base (589)..(589): a, c, t, g, unknown or other
  misc_feature (589)..(589): n is a, c, g, or t
  modified_base (591)..(592): a, c, t, g, unknown or other
  misc_feature (591)..(592): n is a, c, g, or t
  modified_base (594)..(604): a, c, t, g, unknown or other
  misc_feature (594)..(604): n is a, c, g, or t
tcagtacgagtatgcacgaccggtgctcgatttagtacacacacttagggagttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctgaggggtttctaatcgcttctctggctcaagtctggcaacacggccctcctgaccatctcgtgggcctccgaggctgaggacgaggctagtattattactgccagctcatatacaagcaagccaagcaactcgtaacgtcgttaccgggaaacgtcgggggaacccaagggtaccctaccggttccttaagggccaacggccccgaaaccgggtccccaaaccccgtactcgtaccctaaccgttcccgttcccggtttacccccgtccccttaccctcccctaaccgttcccttaccggttaccgtcgggaaccggtccgggggtacccgttacggggaccggtaacgggcccggtaccaagtaaccgnncncncnnnnncngnncnnnnnnnnnnn

SEQ ID NO: 199308 - DNA, 656 bp, Homo sapiens
  misc_feature: GYAE6OF02J0NCP.18.59.F04.1.454.CMB.1.raw
  modified_base (272)..(272): a, c, t, g, unknown or other
  misc_feature (272)..(272): n is a, c, g, or t
  modified_base (309)..(309): a, c, t, g, unknown or other
  misc_feature (309)..(309): n is a, c, g, or t
  modified_base (478)..(478): a, c, t, g, unknown or other
  misc_feature (478)..(478): n is a, c, g, or t
  modified_base (613)..(613): a, c, t, g, unknown or other
  misc_feature (613)..(613): n is a, c, g, or t
  modified_base (623)..(623): a, c, t, g, unknown or other
  misc_feature (623)..(623): n is a, c, g, or t
tcagtacgagtatgcacgaccggtgctcgatttagtacacacacttaggagttgggggctttgtctgggtctcctggacagtcgatcaccatctcctgcactggaaccagcagtgacgttggtggttataactatgtctcctggtaccaacagcacccaggcaaagcccccaaatcatgattatgatgtcactaatccggcctcgaggggtttctaacgtcgcttctctggcttccaagtcgtggaccaacgccggcccttccgcgaaccgntcctctcggggacctccgtaggcctggaacgggacgnggcgttcgaattttactacgtcgtacgacgtctactaatactaaaccgaggacccaacacgcctaactccttacgttatcgttaccgttacggaaccgttcgggaaccctaagggtccctaacccggttctaacgggttccaacgtaccccgaagtccccaaccccgtntacgtaccccttcgtcgttccccggtacccctacccttccgtaacctaccgtacttcccgtcggtcgaaccgggtccgggtacgcgggaaccgtacgggactacccgtaaatccggtacacgtcgacacgtctcncgcgcgtctntcgacgtacagacgacgtacgctcgtacgagcg

SEQ ID NO: 199309 - DNA, 712 bp, Homo sapiens
  misc_feature: GYAE6OF02FWQMT.18.59.F04.1.454.CMB.1.raw
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgcttattttaaaggtgtccagtgtgaggtgcagctggtgagtcgtggggagcttgggtaaggccggggggtcccttagacctcccctgtacagcctctggattcactttcagtaaggcctggatgaactggcccncaggctcgagggagggcgtggnggtgggttggacgtaactaaaaccgaaagtgaagtggtacggacaaacgagaccgtacgacgtacgccgtaacccgtaggaaaacggcaaggtacttaccaacctatacctacgaagtaactattagaaattaacgaaaaagtccgaacgtcttaagtactacgtagaactaaaagtacgaaacacgtacccgtaagaacgaaaccgggacggaaacctaaccgaccggtaaccggttagttaacgtttaaccgtacgtaaaccctaacgtacccttaccccgtaagaaccgaaccgttaaccaacctttaaacctaacccgttaacgtacggtttaacgtacccggtaacccttacggggtaccggggacccgtaacgggtaacccccgg

SEQ ID NO: 199310 - DNA, 557 bp, Homo sapiens
  misc_feature: GYAE6OF02F1KHF.18.59.F04.1.454.CMB.1.raw
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (546)..(546): a, c, t, g, unknown or other
  misc_feature (546)..(546): n is a, c, g, or t
  modified_base (554)..(554): a, c, t, g, unknown or other
  misc_feature (554)..(554): n is a, c, g, or t
tcagtacgagtatgcacgaccggtgctcgatttagtacacacacttagggattgggggctttgcctgggtcctgggcccagtctgccctgactcagcctgcctccgtgtctggggtctcctggacagtcgatcaccatctcctgcactggaaccagcagtgacgttggtggttataaactatgtctcctggtaccaacagcaccagcaaacgccccaaactcatgatttatgatgtcactaatcggcccctacgtaggggtttactaattcgctttctctggctccaagtcnggacaacacggcctcctgaccatcctcncgggctccgagctgaggcgaggctagtattattactgacngctacattanacgaancacacgcactctctagtcgtacttcggaagtcgggacctaggtccaccgtccgtaggtccacgtacccgaacgcccgaaccctacgctaccgacttccgtctcccctacccttctacctactcctacgtctacgcggaccggctcggtaccgaacggcgcgtaactacgntacagtcncag

SEQ ID NO: 199311 - DNA, 561 bp, Homo sapiens
  misc_feature: GYAE6OF02GEF85.18.59.F04.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (444)..(444): a, c, t, g, unknown or other
  misc_feature (444)..(444): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtggttataactntgtctctggtaccacngcaccaggacaaacgcccccaaactcatgatttatgatgtcactaatcgccctcgtagggtttctaatcgtcttctcgtggctccgaagtctggaccaacgacggtccctccctcgacctatctccgtcgggcctcgaggtctggacggacgtaggctagtaatttacgttcgngcacgtctacgatataacgacgcaaccacgcactctactatcgtacttacggacgtacgggaacctacggtccctaccgttactacggctaccggaccaacggaccccaaccctacg

SEQ ID NO: 199312 - DNA, 743 bp, Homo sapiens
  misc_feature: GYAE6OF02HHZ5X.18.59.F04.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacgaggtcctggcccagtctgccctgactcagcctgcctcgtgtctgggtctcgtggacagtcgatcaccatcgtcctgcactggaaccngcagtgacgttggngttataactntagtctctagtaccacagcacccgaggacaaacgaccccaaatcgactgtaatttatggatcgtacaacgttaaacgtccggtacccttacgtacgggtttactaacgtcgtcttacctcgtcggtctaccgaaacgttcgtacggaactaaacgaccggcccttacccgtacgtaccctaacgttccgtacgtcgggtacccttacgacggtcgtacgggaagggtacggaacggttccgtaagtaactttaacgttaccgtacggtacctacgggtactaccggttaaactaacgttaaacccgaaggtaacccaacggaacgacccgttaactttacctaccgtttaacgttaccggttacgttaacccgggttaaccggtacggggttaaaccctaaaccggggttaccgttaaccccggtacgtttaccgggttaccgaacccgttaaccccggaaacggttacccccaaaccccggttaaccgg

SEQ ID NO: 199313 - DNA, 727 bp, Homo sapiens
  misc_feature: GYAE6OF02GAUQ4.18.59.F04.1.454.CMB.1.raw
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacngcaccaggcaaacgcccccaaatcatgtatttangatgtcactaatccggcctgtagggtttctaatcgtcttctctgctcaagtctggacaacgacggcctccctgaccctatccgttcgtcgggccttaccgacgggtcttaggaacgggtaccggaggtacgttacgtaattttaacttaccgttgaccaaggtcctactaactaacgttaacgaaacggaccaaccgtacgtaccctaccgttactaccttacgttcggttacccgtttaccgggaaaccgttacggggaacccgtaaacgggttcccgtaacccggttacctaagggttcccaacggtaccccgaaaccggaccccctaaaccccgtacgttccggtaaccttaccgttacccgttccgttacccccgtaccccttacccgttacctaacctttacccgtaccggttacgtacgggaccggttaccggggtacctacgggaaccgaaccgggtccgaacgttacggacgtcacgac

SEQ ID NO: 199314 - DNA, 715 bp, Homo sapiens
  misc_feature: GYAE6OF02FMDIW.18.59.F04.1.454.CMB.1.raw
  modified_base (218)..(218): a, c, t, g, unknown or other
  misc_feature (218)..(218): n is a, c, g, or t
  modified_base (678)..(678): a, c, t, g, unknown or other
  misc_feature (678)..(678): n is a, c, g, or t
tcagtacgagtatgcacgaccggtgctcgatttagtacacacacttagggagttggggggggtcgtcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcngacactggaaccagcagtgacgttggtcgttaataactatgtctcctggtaccaacagaccacccgaggaccaaacgccccccaaactcctatcgtaattagtgatcgtctaagtaacgtccggtccctggacgggttttacttaagtccgctttacctcgtcggtctacccgtaagtcgtacggtaccaaacgtcccggtacccttaccccgtgtaacccctatcccgttacgtcgggcccttcccggaacgggtccgttacgggaacgggtaccgggtagccgttaggttaacgtttacttaccgttcgccgaaggttacccttcaagttaactaaccgaacgaccgtaagtaccgacgtaccctaccgtacgttaaccggttacgtttaccggaaaccggttcggggaaaccctaacgggtaacccgtcccgttaaccggtacggtacccgtaaccnccccggaaaagtccccccgaaaccccgttcgtaaccg

SEQ ID NO: 199315 - DNA, 831 bp, Homo sapiens
  misc_feature: GYAE6OF02HR72V.18.59.F04.1.454.CMB.1.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
tcagtacgagtatgcacgaccggtgctcgatttagtacacacacttagggattgggggggggtctcaggaggcagcgctctcgggacgtctccaccatggcctgggctctgctattcctccaccctcctcactcagggcacgagggtcctgggcccagtctcgccctgactcagcctgccctccgtgtctgggtctcctggacagtcgatcaccatctcctgcacgtcggaaccngcagtgtacggttggtagttataactntgtctctcgtaccacacgccaccgagaccaaaccgaccccctaaactacctatgtaactttatagtacttgtaccaacgttaacgtccggtccccgttacggttacggggttttacctaacgttccgttacctttccgtcggttccgtactaccctaacggttctcggtaaccgaaccgtaccccgggtccccttaccccgtaccggtaaccctttacgttccccgttacggttcccggggtacccttaccccgggtacggggtccggtaagggaaccggggtaaccggtaacgggttcctttaagggttaaacgtttttaaaccgtttaccgtcgggacctaacgttcctaaccgtaactttaaccaaaccgaaccgtaccaacccgtaacgtacccttaaccctttccgttaaaccgtttcgtttaccgggttttacccgtaacggttaacccgggttacccgggaaaccccgttaaccggggttaccctaacccggttaccgggtaacccgttacccgggaacccgtaaccccgggaaacccgtaccccccgaaccccttaaccgg

SEQ ID NO: 199316 - DNA, 526 bp, Homo sapiens
  misc_feature: GYAE6OF02FZJBI.18.59.F04.1.454.CMB.1.raw
  modified_base (365)..(365): a, c, t, g, unknown or other
  misc_feature (365)..(365): n is a, c, g, or t
  modified_base (520)..(520): a, c, t, g, unknown or other
  misc_feature (520)..(520): n is a, c, g, or t
  modified_base (523)..(526): a, c, t, g, unknown or other
  misc_feature (523)..(526): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagcccccaaaactcatgatttatgatgtcactaatcggccctcaggggtttctaatcgcttctctggctccaagtctggcaacacggccctcccgtgaccatctctgggctccgagctgaggacgaggctgattattactgcagcctacatatanaagcaccagcactctctatgtctcggaactgggaccaaggtcaccgtctaggtcacgcccaaggcccaacccactcgtaccactctccgttacccaccctcctcctactacctccgtactgacggcgggtctcggccgaacggcgactagtagcngtnnnn

SEQ ID NO: 199317 - DNA, 900 bp, Homo sapiens
  misc_feature: GYAE6OF02HJ3EW.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccagtggagtttgggctggagcgtggtacttttccgtgctgtcttaagttttaaaggtgtcctagttgtgaggtgcagcgtggtggagtcggtgggggagtcgttagggtaacgggtcccggggggttacccttaggacccgttcccgtgttaccgacgtccctcgtaggtaacttcctaacgtttacgaaggttaaccggccgttagggtactaggtaaccggttcggggtaccccgaccggtacgggaccgtaacccgggaaggggggtaacgggggtccgttagggggacgggttttacgggggttaaccggtaaacccggtttaaaaacgtttaaaaaaccccgaaaaggttggtaaacggggttacgggggttaaacgggaaaccaaacggtaaccggtaacctaaccgggtaccgtagaaccccgtacccggtaaggaaacggcgtaaacgtacgttacccaacgtactacctaacgaagtaacgtataagtaactaaacgaaaacgcgtaaccgtagtacgtacttacgacgtaaacaagtaacgaaaccgtcggaaccgtagaaacccggtaacgaaccgtaacgaaccggtaacgtaccgttaacttaacgttaaccgaccgtaacccgtaacctaccccggttaaccggtaacgaaaaccgggttacccgtaaccgtttaaacccccgttaagtttaaaccccggtaaccggttttaaccggtaaccccggttacggtaccccggttaaccgggg

SEQ ID NO: 199318 - DNA, 678 bp, Homo sapiens
  misc_feature: GYAE6OF02GBQ6G.18.59.F04.1.454.CMB.1.raw
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcaccatctcctgcactggaaccagcagtgtacgttggtgttataactatgtctctgtaccaanagcaccnggacaacgccccaatcatgactttangatcgtactactaactccgcctcgtacgggtttactaagtccgtacttccgtcttacggtcctaccgaacgttcgtacgggaaccaaaccgtacccggtcccgttcccgtacgtaaccctacgttccgtaccggttcgggcccttaccggacgggtcctaacggggaacggtaccgggtagggtacccttagtaacgttttaacgttaaccgtggtacctaacggttcctaacgtaattaacctaaccgaacgtacccaaccgacgtaccttaccttctacttacttcggttacccgttaacgggaaccgtaccgggaacctaacgtcccgtacccgtacgttaggtaccctacggacccggtaacccgacccc

SEQ ID NO: 199319 - DNA, 919 bp, Homo sapiens
  misc_feature: GYAE6OF02F62G4.18.59.F04.1.454.CMB.1.raw
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtcgtgggtctccgtggactagtcgatcaccatcctcctgctactcggaaccngcagtgtacggttggtagttaataacttntgtcctccgtacggtaccaaacgngccacccgaggaccaaaccgacccccctaaactcagtgtactttatagtatacgtactaacttaacgtccggtaccccttacggtacggggttttactaaacgttccgttaccttccgtaccgtagggtcccttacccgtaacggttcgtacggacctaaccgtacccggtccccgtaccccgtaccgaccctacgtcccgttccgtacggggtccctaccggtaacgggtcgtaacgggaccggggtaaccgggtacgggttaccgtaacggtttaaacgttttaaccgtttaaacccggttcgtaccggtaaccgttacccgttaacgttaaaccgtttaaccgtaaaaccccggtaaacgtaacccctaaaccccggtaaccgtaaccccgtttaaccgtttaccccgtttaacctttaccggttttaacccggttttccccgggtttaaaacccgggggttaaaaccccgggtttccccgggggtaaaaacccgtttaacccggggttaaccccggttaaaccccggtttttaaccccgggttaaccgggtttaaccccggaaccccggttaaaccccccggtaaccccgggtaaaccccccccgttaaacccccggtttaacccccgg

SEQ ID NO: 199320 - DNA, 581 bp, Homo sapiens
  misc_feature: GYAE6OF02FJ4VJ.18.59.F04.1.454.CMB.1.raw
  modified_base (231)..(231): a, c, t, g, unknown or other
  misc_feature (231)..(231): n is a, c, g, or t
  modified_base (451)..(451): a, c, t, g, unknown or other
  misc_feature (451)..(451): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctggggtcctcctggacagtcgatcaccatctcctgcactggaaccngcagtgacgttggtaggttataactatgtctcctggtaccaacagcaccaggacaacgcccccaaatcatgtattatgatgtcaactaagtccggccctcgtacgggtttctaagtccgtcttctcgtggcctacctagtctggacaacgacgtccctcctactacctatcctcgtcggcctccgacggcgtacgaggacgaggcgtagtacttattacncgtacacgtcactataatacgacaccgacgacgctactctactgttcgttaccgtacggaacgtcgggaaccgacggttcccgaccgtacgtacggtaccgaccgacccgacggaccccaacccgtaccg

SEQ ID NO: 199321 - DNA, 708 bp, Homo sapiens
  misc_feature: GYAE6OF02FIBBZ.18.59.F04.1.454.CMB.1.raw
  modified_base (235)..(235): a, c, t, g, unknown or other
  misc_feature (235)..(235): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcaggtcacagggtcctgggcccagtctgccctgactcagcctgccctccgtgtctgggtctccgtggacagtcgatccaccatcctcctgccactggaacccnggcagtgtacgttgggtacgttataactatcgtcctccgtggtaaccaacacgtccacccgagggaccaaaccggccccccctaaactcagtntaatttagngtacttgtacacgttaactccggtaccctcggtaacggggttttactaacgtcgtcctttctacgtcgggtacctaccgttaacgtccttacgggaccaaccggtacccggtcccctacccgttacgaaccctacgtcgttaccggttcggggaccctccggtaacggccgttaggaacgggtaccgggaccggtacgttaacgtaacgtttacgttaactcgggacctacgtccgtactaacgttaacacgtaacgacgtacggacgtacgacctaactccgtaagttccgttacgaaccgtcggaacctacggtcctacccgtcgacggtaccaccggacccgacggaacccctacccgtacttacccg

SEQ ID NO: 199322 - DNA, 768 bp, Homo sapiens
  misc_feature: GYAE6OF02HOTHH.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgcttaattttaaaaggtgtccagtgtgaggtgcagctggtggagtcgtgggggaggcgttagggtaaaggcccgggggggttcccttagacctccccgtgtacacgtcctcgtggacttccgactttcaggtaacgcctggaatggaacgtgggtaccgccgaggcctaccggaggggaacggggtctgggtaggtcggggttcgggtacccgttaaacgttaaaaacccgtaaaaacgtggtaagttcggggtaaggaaccgaaacgtagaaccgtacggtctcggacccgacccgggtaggaaaacgggcgaaagtacgttacccaacccgtatccgtaaccaaaggtacgaagtacgtaaattaacgaaaaaacgtccgaacgtacttacggttaactacgtaggtaacctaaagtacgaaacgacgtaccgaaggtaacggtaaacccggaacggtacccgtaacgacggtacccgtttagtaacgtttaccgtacgtaaccgacctaccgtaccgtaacggtaaacgtaccgtaacctaaacgtaccgtaacttaccggtacgtacgttaccggtaccttacggtaccgggaccgg

SEQ ID NO: 199323 - DNA, 913 bp, Homo sapiens
  misc_feature: GYAE6OF02GGYZX.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagttgggctgagctggatttccttgctgctatttaaaggtgtcctagtgtgaggtgcagctgggtggaggtcgtgggggaggtcgttagggtaaacgggcccgggggggttacccttagggaccttcccccgtaggtaaccacgtccctccgttggggtacttacctaacctttttcgaacggttaaaacgggccccgttaggggtaattacggtaaacgtcggggggttaccccggaccccgaaggggtcccgttaccccggggaaaggggggaaacgggggtaccggttacggggtacggggtttggggggtttacgggacccggtttaaacgtttaaaaaaaccccgtaaaaacgttacggtaagtttacgggggtacggggaaacccgaaacgtaacggtaaccgtaccggtaccgtacggacccgtaacccgggttaagggaaaacggtaccgtaaggtaaccgttaccaaaccctaacgttccgtaacctaaaggaggtaactaggtaaacttaaaccggaaaaaacgtccgaaccggtacttaacggtacttacctaagtaaacgttaaacgtagtaaaccctaccggtaccgtaagggaaaccgggtaaacccggaagggaaccaaccgtacgggtacccgttagtttaaacttacgtaccgtaccctactaaccgttccccgaaaggtaaccggtaccgtaaccttaaaccttaacccgttaccgtaaccgttaacggtacgttaccggtacccgtaacgggg

SEQ ID NO: 199324 - DNA, 792 bp, Homo sapiens
  misc_feature: GYAE6OF02GHWH8.18.59.F04.1.454.CMB.1.raw
  modified_base (205)..(205): a, c, t, g, unknown or other
  misc_feature (205)..(205): n is a, c, g, or t
  modified_base (660)..(660): a, c, t, g, unknown or other
  misc_feature (660)..(660): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgtcttaagttttaaaggtgtccgagtgtgagtgnagcgtggtggagtcgtgggggagtcgttaggtaaacgggccggggggttccttacgaccgtccccgtgtacacgtcctcgtacggtattcctactttcgagttaacggccgtggaattacgtaacgtcgggtccgaccgtacggtcccgtccggagggggtaacgggtcggttacgggagggtttcggggttacggtaacccggttaaaattaaaaaacccgtaaaacgttcggtaaaggttacggggtaacgggaaaccgtaagaacggtaaccgtacggtacctcggtacccgtaaccggtaggaaacggcgtaacgtaacgttaccgaaacctacgtaccgtaacgaaagtacgtacgtacgtaaacttaaacgaaaacgtcgaacgtactagttactcgtagaacgtaaagtcgaactacgtacgacgaaacggaccgaagacccgtaacncggtaccgttacgttaactaccgtaacgtaccccaacgtacccgttaacccgaacggttaaaaccgcccttaaacaaaccgttaccgttaaccgtaccgttaacccggtagttacccgtaccgttaaccggg

SEQ ID NO: 199325 - DNA, 758 bp, Homo sapiens
  misc_feature: GYAE6OF02HEFME.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcttgggtaaaggccgggggggttcccttaggaccctcccgtacgtacgacgtccgtcgtaggtacttaccttactttacgtaaggttaacggtccgtaggtacgtacggtaaccggtcgggtacccgccgacggtccgtaccggaagggggacgggcgtaggtagggttcgggtcggtaccgttaaacgtaaaaaccgtaacgtagtaggtagggtacggaacgaacgacgtaacgtaccgtgtacgaccgaccggtaacggaacgacgagtactaccaactacgtactacgaagacgtataacgttaactaaaaccggaaacgtccgaacgtacgttactacgttaccgtaagaaacgtaagtaacgaaaccgacgtcgtaacgggaacgaacggtaaccgacaccggtacggttacttaacgtttactaactaccgtaaccacccgtacctaccgtaggaaaccgtcctaacgaactaacccgttattaaccggtacgtacgttacccggaccgttacgggacgggtaaaccccgg

SEQ ID NO: 199326 - DNA, 779 bp, Homo sapiens
  misc_feature: GYAE6OF02IL2XH.18.59.F04.1.454.CMB.1.raw
  modified_base (138)..(138): a, c, t, g, unknown or other
  misc_feature (138)..(138): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcanagggtcctgggcccagtctgccctgactcagcctgcctcgtgtctgggtctcgtggacagtcgatccacatctcctgcacgtcggaaccgactagtcgtacggtttgggtacgttaataactagttcgttccttccgtacggtaacccaacgacgacctaccccgaagggaccaaaaccgacccccctaaaactaccaacttgttaactttttacgtacggtacgttcgtaccgtaaaccgttaaccgtcccggtccccgttacgggttaacggggttttacctaaaccgttccgtccgtttacgttccggttcggttaccctaccgtaaacgttccgtacggggaaccctaaaccggaccccggttaccctaccccgtaccggtaacccttacgttcccgttccggtccgggttaccctaccgggacggtccggttaagggaaccgggacggtaacgggtcttaagggtttaatttaaccgttcgtacgcctacgtacctaactaagtaactacgtaaccgacctaacgcgttacctaccttctaactgttacgtcgttaccggacgtaccgggtaacgtacgttacccgaccgttacgtacgaccgaccgtacccgaaccggtacccctaaccgtaccg

SEQ ID NO: 199327 - DNA, 796 bp, Homo sapiens
  misc_feature: GYAE6OF02FUZJW.18.59.F04.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacngtcgatcaccatctcctgcactggaaccngcagtgacgttggtagttatactatgtctcctggtaccaacacgcacccaggacaaacgcccccaaactcatgtatttatgatgtacaactacgtcgtccctacgtagggtttactaacgtcgtcttctcgtggtcctaccgtaacgttcgtacggtaccaaaccgtacccgggtaccctttccccgtacgtaacccctaacgttcccgttccgttacggggtcccttaccccggaacgggtccgttacgggaacggggtaaccggtacgggtacctacgggttaacgtttaacgtttacgtacggtaccgtacggtccttaaccgaactttaacgtaaccgtaaacgacccgtaaacccgtacggaaccctaacccttaccgtttaacgttaacgttaccggttttaccgttaaccgggtaacccggtttacggggggtaacccttaaacccggggttaaccccggttaaccccggtttaccccggtttaacgggttaccccggtaaaccgggtaaccccccggtaaacccgggtaacccccccgtaaacccccggttaaccccgg

SEQ ID NO: 199328 - DNA, 641 bp, Homo sapiens
  misc_feature: GYAE6OF02ILSAC.18.59.F04.1.454.CMB.1.raw
  modified_base (222)..(222): a, c, t, g, unknown or other
  misc_feature (222)..(222): n is a, c, g, or t
  modified_base (262)..(262): a, c, t, g, unknown or other
  misc_feature (262)..(262): n is a, c, g, or t
  modified_base (431)..(431): a, c, t, g, unknown or other
  misc_feature (431)..(431): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagcggtcgtagttcctaggcgtcgattaagtttaagtgtcagtgtgaggtgcagctggtgcgtgtgggggagngttggaaaggccgggggtcccttagactcccctgtacgcncctctggtacttcactttcgaagagtcctaggatgacgttggtccgacaggtcctccgaggggaacgggcgtgggtaggtgggttcggaccgtaaattaaaccgaaatgagtcggtaggacaagacgctacgcgtacgcctacggtagaacggcagtaacttcaacctntactacgaagagtacgtataactaaacgaaacgtcgacgtacgtatacgtcgtaacgaacgtaacacgtaacgtacgacgtaaggaacccggactacggaactacgtacgtacgttagttaactcctacgtaccgaacttccgtaaccgacgtcgtacctataaccgtacgtacgtaccgtacggtacgtcggtacgttcggacggacgg

SEQ ID NO: 199329 - DNA, 528 bp, Homo sapiens
  misc_feature: GYAE6OF02F2OG1.18.59.F04.1.454.CMB.1.raw
  modified_base (266)..(266): a, c, t, g, unknown or other
  misc_feature (266)..(266): n is a, c, g, or t
  modified_base (508)..(528): a, c, t, g, unknown or other
  misc_feature (508)..(528): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcgaggggtttctaatcgcttctctggctccaagtctggccaacacggccctccctgacctntctcgtggcctccaggctgacggacgaggcttgtatttattacgtgcagctcaataatacaagccaccagcactctctagtcgttcttacggacgtacgggaccaaggtccaccgttcgtaggtcacgtacccgaacggaccccaccccgactcgtcacctcctccgttccccgtcccctccctcctacctaccttacgtactcgacggcgggccgtttcggaccgtaggccgcgacgtcgnnnnnnnnnnnnnnnnnnnnn

SEQ ID NO: 199330 - DNA, 638 bp, Homo sapiens
  misc_feature: GYAE6OF02JHM4Y.18.59.F04.1.454.CMB.1.raw
  modified_base (232)..(232): a, c, t, g, unknown or other
  misc_feature (232)..(232): n is a, c, g, or t
  modified_base (293)..(293): a, c, t, g, unknown or other
  misc_feature (293)..(293): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgccagtggaaaccngcagtgacgttgggtagttataactatgtctcctggtaccaactagcacccaggacaaacncccccgaaaactcatgtacttagtgatgtcaactaatccggccctcgtaggggtttctaatcgtacttctcgtcgcttaccaagttctggacaacgccgtccctccgtcgacctactctccgtgggacctccgacggcttggagggacgacggctagtctttaattacgtgaccgagtccacgtataacgtacgaacgtaccgaaccagaccttcgacttaccgtaattacgttaccgtttaaccgggtacgtaacgggggtaaccctaacgggttaccgtaaccccgttacgtaaccggttcgaacccggacccgtaaaccggaccccgtaaccccctaaccgg

SEQ ID NO: 199331 - DNA, 640 bp, Homo sapiens
  misc_feature: GYAE6OF02HRPKZ.18.59.F04.1.454.CMB.1.raw
  modified_base (443)..(443): a, c, t, g, unknown or other
  misc_feature (443)..(443): n is a, c, g, or t
  modified_base (482)..(482): a, c, t, g, unknown or other
  misc_feature (482)..(482): n is a, c, g, or t
tcagtacgagtatgcacgaccggtgctcgatttagtacacacacttagggattggggggggtctcaggaggcagcgctctcgggacgtctccaccatggcctgggctctgctattcctccaccctcctcactcaggcacgaggtcctgggcccagtctcgccctgactcagcctgcctccgtgtcgtgggtctccgtggacagtcgatcaccatctcctgacacgtaggaaccagctaggtcgtacgttggtagtttaactactagtcgttccgtccgtaggtaaccacacgccaccgagaccaacgacccccaaatcactagtactttagtgtagttcgtacaacgttacgtccggcccttaggttacgggttactaacgtcgttacttccgtcgtcgtacctacgtagtcgacgacgaccgtaccgtccctcgtactaccncgttccgtacgtcggctaccgaggcgtaggacggtacgnggtcgtagtacttactcgtgactgtacctactaagtactaacaccgtacacctagccttacgtactagttacgtcgttaccgtacggtaaccggtcggaaccgtacgtaccgtaccgtacgtacgaccgaccgtaccgtaaccggtacccaccgtacg

SEQ ID NO: 199332 - DNA, 762 bp, Homo sapiens
  misc_feature: GYAE6OF02I5140.18.59.F04.1.454.CMB.1.raw
  modified_base (756)..(756): a, c, t, g, unknown or other
  misc_feature (756)..(756): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggtataactatgtctcctggtaccaacagcacccagacaaacgcccccaaactcatgtatttatgatgtacactaatccggccctcgtagggtttctaatcgtcttctctggctccgaagtctggacacgaccggccctcctcgaccacttcgtccgtcgggcctaccgacgggtcgtacggaacgggaccggtaacgggtccttacggttaatttaactttaacccgtaggtacccacgggtaccctttactaaacgtttaactaaaccgaacgtacccgtaaccccgtaagtacccctaaccttacctttactaacggtttccgttaccgttttaacccgggaaaccggtttaccgggaaccgtaaacggttacccgtaacccgttaccgttaaccgggttcaacccgtaccccggaaaccggtaccccccgaaccctacgttaccgtaacccgttacccttacccgtttacccgttcccccctaccctttacccgacccgtaacttacccttacgtaccgtcggtaccgggtacccggtccgtcgggaacccttaacgggccgtacgtaaggttacacgctacgntacgcg

SEQ ID NO: 199333 - DNA, 868 bp, Homo sapiens
  misc_feature: GYAE6OF02HURFU.18.59.F04.1.454.CMB.1.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcacatctctncactcgaacngctagtgtacgttggtaggttataactatcgtcttccgtggtaaccaatacgccaaccaggactaacgaccccaactactatagtatttagtagtatacgtactactaacgtccggtacctacggtacgggttttactaacgttccgtccgtttaccgttaccgttacggtacccgtttacgtaaacggttcccgttacggggaaccctaaaccccggtacccggggtaccccctttaccccgtacccgggttaacccgtaaccgtttccccggtttacccgggttaccggggttacccctacccccggtaaggggttccgggtttaaccggggaacggggttaacccggggttaaccggtaccggttaacggttttaacgtttaacccggtttaacggtacgtaccggtacccgtaccgtttaaccgtaaacgtttaaccgtaaaccgaaccggtaccctaaaccggtaccgtaacccgttaacctttacccgtttaaccgttaccggttttaggtttaccccggtaacgggtttaaaaccggtcccggggtaaacgttaacccgggttacccgttacccggttaacccggtacggttaacccggacccggtaaccccggtaaccgggtaacccccc

SEQ ID NO: 199334 - DNA, 677 bp, Homo sapiens
  misc_feature: GYAE6OF02IUWJ4.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgccactggaaccagcagtgtacggttggtaggttaactactattgtcctccgtacggtaccaacacgaccacccaggaccaaacgacccccaaactcatatatttagtagtatcgtactaactacgtccggtacccttacggtacgggtttactaacgttctctttcctacgtcggtacccttacaacgttcgtcggacctaaccgaccggccccttacccgtacgaccttcttctccggtcggtcctccgtaggtccgtaggaacgggacggtacggtacctagttaatttacgttacgtcgtacgtacgtctaacctaataacgtaacgacgaacacgacacacctaacgtaccgtaacgttccgttacggacggtaccggtaaccgtaacggtccgtacccggtacgttaccgacgtaccggacccgaacccggacccctacccgtaccgtacccg

SEQ ID NO: 199335 - DNA, 713 bp, Homo sapiens
  misc_feature: GYAE6OF02F9ZTT.18.59.F04.1.454.CMB.1.raw
  modified_base (585)..(585): a, c, t, g, unknown or other
  misc_feature (585)..(585): n is a, c, g, or t
tcagtacgagtatgcacgaccggtgctcgatttagtacacacacttagggattgggggggaggaggagccccagccttgggattcccaagtgttttcattcagtgatcaggactgaacacagaggactcaccatggagtttgggctgagctggattttccttgctgctatttaaaggtgtccagtgtgagtgcagctggtggagtcgtgggggaggcttgggtaaagccgggggggtcccttagactccccgtagtacagcctcgtggattcactttcagtaaggcctggatgaactgggtccgcgaggctccgaggggtaacgggcgtgggagtggggtcggaccgtaagttaaaaccgaaaacgtcgaagttgggtaggacgaaacgagaacgtaacgcgtacgcgtaacccggtaggaaaacggccgaagtaacttaccgaaccgtactaccgtacaaaggaagaacttaggtaaacttaaccgaaaaaggtaccacggtactaagtacgttacctagaacgtaaaattcgaaactacgacctagggaacgtaaaccggacggaacaacgacgtaccggttntaacgttactcgttaaaccgactaacgtcccctagaaacgtccggtaactaaaccgttacctaacgttaaccgttaccggttaacttcggaacccgttaggacccggggtacaaaccgggtaacccgg

SEQ ID NO: 199336 - DNA, 906 bp, Homo sapiens
  misc_feature: GYAE6OF02HHS6R.18.59.F04.1.454.CMB.1.raw
tcagtacgagtatgcacgaccggtgctcgatttagtacacacacttagggagttgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacacggtcgatccgaacctattccgtcctgccaacgttcggaaccagacctaggtcggtacgtttgggtaggttaattaacgtagttcgttccttccgtacgggttaaaccaacgacggacccaacccgacggaaccaaaaccgaccccccctaaactaccagttagtaacttttaagtcgtaatcgtaccacttaacgtccggtcccttacggttaggggtttacctaacgttcgtacctttccgttcgtacggccttaccgtaacgttcgtacggaacctaacccgtacccgggttccctccccgtacggaacctacgttccgtccggttacgggtcccttaccggacgggtccgtagggtaaccgggtaacgggtacggttcgttaggttacgttttaacgtctacggtacgtagttaccctacttaacgttaacgtaaccgtaaaccggtacccgtaacccgtacgtaccgtttaaacccttccgttaaccgtttaacggtttccgggtttaaccccgttttaaccggggtaaaccgggtaaccgggggttaaacccccggttaaaccggggtttaccccgttaaaccccccgggtttaaccgggtttacccgggttaaccccggtacccccgggttaaaaacccccgggtaaaacccccggggttacccccccccggtaaaaaccccccgttaaccgggg

SEQ ID NO: 199337 - DNA, 815 bp, Homo sapiens
  misc_feature: GYAE6OF02IM0ES.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctggtctccgtggacagtcgactcaccatcctcctgcactcggaaccagcagtgtacgttggtaggttaataacgtatcgtctctcggtaaccaacgacgccaacccgagaccgaaaaccgacccccaaactcatacgtatttacgtagtaatcgtactaacgtaacgtccgaccgtacggttaagggttacctaagtccgtcctttacgtccgtacggtcctaaccgtaacgttcgtacggtaaccgaaccgtacccggtaccccttacccggtaacaacccgtacgttccgtaccggtcgggtaccctacccggtacgggtacgtaacgggtaacggaccgggtaacggtccgttaaaggttaaattttaaccgttaaccgttacgtaaccgtacggtacctaaccgtaaactaaacgtaaactaaaccggtaccaaacccgaagtaaccccttacgtttaacccgttaacttacgttaccggttaccggttaaaccggtaaccgggttaacggggaaacccgttaacggggtaaccccgttaacccggtttacccggaacccgggttaaccgaacccccgggttaacccgaaacccccgggttaccccctaaaacccccggtttaccg

SEQ ID NO: 199338 - DNA, 709 bp, Homo sapiens
  misc_feature: GYAE6OF02HUYO9.18.59.F04.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (364)..(364): a, c, t, g, unknown or other
  misc_feature (364)..(364): n is a, c, g, or t
tcagtacgagtatgcacgaccggtgctcgatttagtacacacacttagggattggggggggtctcaggaggcagcgctctcgggacgtctccaccgatggcctgggctctgctattcctcaccctcctcactcagggcacagggtcctgggcccagtctcgcctgactcagcctgcctcgtgtctgggtctcctggactagtcatcaccatcgtctgcactggaacngcagtcgacgttggtgttactaactntagtcttcgtaggtaccaactagccaccgagaccaacgaccccaaactcatgaatttatagtactagtacacttaacgtcgtaccctcgtagggttctaacgtcgtcttcncgttcggcctacgtaacgtcgtacggacgtaacgaccggtcccttcccgtacgaacctacgttccgtcggttacggtcctaccggtacggccgtagggacggaacggacggtcgttacggtaactttacgtttagtcggactaggtacctaacgttaattaaaccgtaaccgaacggaaccctaaccggtaacgtaccttaaccttacgtaacctttaagttccgtttacggtttaacccgggtaaggtaaccgggaaacccgttagggtcccttaaccggtaccccggttaggtacccgttaaccggaaccccgtaaccgggtaccccttaaccccgttaaccg

SEQ ID NO: 199339 - DNA, 691 bp, Homo sapiens
  misc_feature: GYAE6OF02GX665.18.59.F04.1.454.CMB.1.raw
  modified_base (273)..(273): a, c, t, g, unknown or other
  misc_feature (273)..(273): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacngcaccaggcaaacgccccaaatcatgtatttatgattgtctactaatccggtccctacgtacgggtttactaactccgtcttctcgtcggctcgtaacgtcgtacggacctaaccgaccggtcccttacccgtcggaaccctacttccgttccgttacggggtcccttaccggacggtcgtacgggaaacgggtaccgggtacggccgttaggtaactttaacttacgtacgtacgacgtaccttactaacttaacgtaacaacggtaccaaccgtacgacctacgttaccttacgttacttcggttaccgtttaaccggaacggttaccggggtaacccgtaacgggtttaacccgtaacccgggtttccgtaaccggttacccgaacccggtaccccgaaaccggtaacccccccg

SEQ ID NO: 199340 - DNA, 754 bp, Homo sapiens
  misc_feature: GYAE6OF02F4HT8.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgctccgtgtctgggtctcctggacagtcgatcacatctctgcactggaaccagctagtgacgttggtaggttaataactatcgtctccgtaggtaaccaacacgacaccaggacaaaccgtaccccaaactacaagttacgtaagttttaactagagtacgttacaactaaacgtccgggtaccctacggtaacgggttttactaaacgttcgtacctttactccgtcggtacctaccgtaaagttcgttagggaccaacgtacggcccttcccgtacgaactacgtttcctacggttacgggtcctacggtaacgtccggttagggaaacgggaccgggttaacggtacgtacgttaaacgttttaacgttaaccggttcggaaccgttacggtaccctttagtaaaccgtttaacaaaacccgttaacggaacccgtaaccggtaacgttaccaacctttacccggttactacgtttcgtttaacccgttacggtaaccgtaacgggtaaccctacggtaccgtaaccgttacgtacgggtaccaacccggtaaccgaccgaacccctacccgtaacg

SEQ ID NO: 199341 - DNA, 351 bp, Homo sapiens
  misc_feature: GYAE6OF02FMRUN.18.59.F04.1.454.CMB.1.raw
  modified_base (342)..(351): a, c, t, g, unknown or other
  misc_feature (342)..(351): n is a, c, g, or t
tcagtacgagtatgcacgaccggtgctcgatttagtacacacacttagggattgggggagagaagacaggattcaggacaatctccagcatggccggcttccctctcctcctcaccctcctcactcactgtgcagggtcctgggcccagtctgtgctgactcagccaccctcagcgtctcgggacccccgggcaggagggtcaccatctctttgttctggaagcagcctccaaacagtcggaagtcacgcccgaaggcctccgccccctcgggtccactcctacgttccccaccctccgtcccatactccgtactgaggcgggctggacaacggcgcatagnnnnnnnnnn

SEQ ID NO: 199342 - DNA, 747 bp, Homo sapiens
  misc_feature: GYAE6OF02ION4J.18.59.F04.1.454.CMB.1.raw
  modified_base (302)..(302): a, c, t, g, unknown or other
  misc_feature (302)..(302): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagtgtcctgggcccagtctgccctgactcagcctgcctccgtgtctggtctcgtggacagtcgatcaccatctctgcactggaaccagcgagtgacgttggtgttatactatgtctcgtggacaacacgacaccagacaacgccccaactcatgtatttagngtatgtacacgtaacgtcggtcctacggtacggggtttactaacgtcgtcttcgtcgtacggcctacgtaacgtcgtacggaccgaacccggtaccggtaccccttacccgtacgtaccctaacgttcccgttaccggtaccgggtacccttacccggagggttccgttacgggaacgggtaccggtaacgggtcgttaacggttaacttttaacgtttaccgagtaccgtaacgtcttaacgtaaagttaactaaccgaaacgtacccgaacccttacggacccgtaacttaccgttacgttacgtcggtttaacccgttaccggggaaaccggtttaccggggaaacccgttaccggggttaacccgtaacccgggttacccgttaaccgggttaccggaaacccgttacccccggaacccggtaacccccctaaacccccgg

SEQ ID NO: 199343 - DNA, 815 bp, Homo sapiens
  misc_feature: GYAE6OF02HSW40.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcgagctggtggagtcgtgggggaggcttagggtaaagccgggggggttcctagacctcccgtgtacagccttctggattcacttttcagtaaggcctggatagaacgtgggtccgcgaggctaccgagggaggggctggagtggggttggtaccgtaattaaaaaccgaaaaactggtaagtgggtacggggaacaaacgagtaacgtaaccgcgtacgacccgtaaccccggttaaggaaaacggacgtaacgggtaactttacccgaaacccgttaacgtaccgtacgaaacggtaggtaaaccgttagaaactttaaacgaaaaaacgtcgtaaccgacttacggtaactcgtaagtacgtaaaacgaggtaaaccacgtaccctaacgggaaacggaaacccggaaaggtacccgaacgtaacgggtacccgtttaacgtaacgtttaaccgtaacggttaaaccctaaccgaccgttaccccgtaaccggaaaacggttcccccggtaaacgttaaaacccctttaaaaccgtaacccgttaaacgttaacccggggttaaacttaacccggggttaaccccgttaccgggttacccgggggggtaaaccccg

SEQ ID NO: 199344 - DNA, 736 bp, Homo sapiens
  misc_feature: GYAE6OF02H2B2W.18.59.F04.1.454.CMB.1.raw
  modified_base (137)..(137): a, c, t, g, unknown or other
  misc_feature (137)..(137): n is a, c, g, or t
  modified_base (156)..(156): a, c, t, g, unknown or other
  misc_feature (156)..(156): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
tcagtacgagtatgcacgaccggtgctcgatttagtacacacacttagggattggggggggtctcaggaggcagcgctctcgggacgtctcaccatggcctgggctctgctattcctcaccctctcactcagggcanagggtcctgggcccagtcngccctgactcagcctgcctccgtgtcgtgggtcctcctggacagtcgatcacatctctncactgaccngcagtgacgttggtagttaactactatcgtcctcttacggtaccaacgtacgcctaaccccgaaggaccgtaaaaaccgacccccccaaaaacgttctaacgttacggttaacgtttttaacgtacgtactacggttaacctaacttaaaccgttccggtccccttaacgggttaacgggttttaccgtaaacgttccggtactttaccgtccgttacggaccttaaccgttacggtacgtaccggaaccgtaaccgtaccgggaccccttacggtaccgtaacccgtacttaccggtaccggttcgggtacccgtctaaccgggtcgtaaccgggtaagggtacggtacggtactttacgggttacttaacgttactacgaacctcgtacctacgaactaagtacaacgtaaccactacgaccttacgtccttaacctagttcgtacgttaacgaggtaccgaacgtacgacgtacctacgacgtaccgcacccgtaaggaccccacgtac

SEQ ID NO: 199345 - DNA, 566 bp, Homo sapiens
  misc_feature: GYAE6OF02GM93X.18.59.F04.1.454.CMB.1.raw
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacngtcgatcaccatctcctgcactggaaccngcagtgtacgttggtgttaataactatgtctcctggtaccaacagccaccgaggacaacgacccccaaatcatgtatttatgtatgtcactactcgcctgtacgggttactaactcgtcttctctcgctccagtctggacaacgcgcctccgngaccngtctcgtcggtctcgacgtctacggaggacgcgtctagtacttagtactgactgtctagattacaacgacgaccaccgtacgctacgttcaacgttagttcttaccggtcggtaacgtacggaacctacgggtacctaccgtcgttacgtcacccgtcctaaccggtacccacccgtaccg

SEQ ID NO: 199346 - DNA, 654 bp, Homo sapiens
  misc_feature: GYAE6OF02I3HEE.18.59.F04.1.454.CMB.1.raw
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (449)..(449): a, c, t, g, unknown or other
  misc_feature (449)..(449): n is a, c, g, or t
tcagtacgagtatgcacgaccggtgctcgatttagtacacacacttagggattgggggggggtctcaggaggcagcgctctcgggacgtctccacatggcctgggctctgctattcctcaccctctcactcaggtcacacggtccgtcggccgacgtctcgccactgtactcacgcctcgtccgtccgtcgtcgtcggtcgtcctcggacgacgtcgactcaccatctcctcgcactacggaaccacgcagtgacggttggtaggtataactatgtctcctaggtacaacagccaccaggacaacgaccccaaactcatcgtatttatgatgtactactaagtcggccctcgtagggttataacncgtcttctcnggctacacgtgtcgacaacnccgtcctcctacgtacacttcgcgtgggactccgagcgtagacgggtcgacgtntcgttattacgtactggtcagtcctataaacgttaactaaccgaagccctaaaccgctaccttacttaccgttcttaagttccgtttacggttaacccgggaaaccgttacgggggaaccctaaaaccgggtttcccgtaacccggttacccgtttcggggaaaccacccgggaaccccgtaacccgggaaccccctaaccccgg

SEQ ID NO: 199347 - DNA, 780 bp, Homo sapiens
  misc_feature: GYAE6OF02GO3RA.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacgaggtcctgggcccagtctgccctgactcagcctgcctcgtgtctgggtctcctggacagtcgatccaccatcctcctgccacgtcggaaccagccagtgtacgttggtaggttaactaactatgtcctccgtacggtaccaacgtacgaccacccgaaggaccaaaccgaccccccaaacttcaacgttacgtaagttttatacgtacgttcgtacctaactaacgtcccggtaccccttacgggttaccggggtttactaagttaccgttcctttccggtttcggtacccttacgtaacggttccgtacggaccaaaccggtacccggtccccttaccccggtaccgtaacccttacgttacccgtcggtcgggtaccctccggacgggtcgtacgggaacgggtaaccggtacgggttcctaagttaacgtttacgttaaccgttcgacggtaacgtcttacctaagttactaaacgtaaccgtacccgaaccgtacgacccttacgttacccttacgttacggttcccgtttaacgttaccgggaacgtaccgggtaaccggtaacggtaccctacccggttacgttacggaccgtaccggtaccccgaacggtaccccctaacccgtacgttaccg

SEQ ID NO: 199348 - DNA, 904 bp, Homo sapiens
  misc_feature: GYAE6OF02IOCCP.18.59.F04.1.454.CMB.1.raw
  modified_base (195)..(195): a, c, t, g, unknown or other
  misc_feature (195)..(195): n is a, c, g, or t
  modified_base (233)..(233): a, c, t, g, unknown or other
  misc_feature (233)..(233): n is a, c, g, or t
  modified_base (900)..(900): a, c, t, g, unknown or other
  misc_feature (900)..(900): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcacatctcctgcactggaaccagcagtgacgttggtggttataactatgtctcctggtaccaanacgcaccaggacaaacgcccccaaactcatgaatttangatgtacactaatccgcctacgtaggggttctaatcgtcttctcgtcggacctaccgtaagtctagacaaccgtaccggtcccttacccgtacgaccctacgttccgttccggtcgggaccgttccggaggtacgtacgggaacggtacgggtacggtaccttaggttaactttaacgtttaccgtacgtaccgtacggttacctacgtaaactttaaacgttaacgaaaaccgaccctacccgaaacggtcccttaaccgttcccgtttaacgtttaccgtttaaccggtttaccgggtttaaacccgggtaaacccggggttaaccggggaaacccggttaaacccggggttaccccgtaaaccccgggtttaacccgggttaaccggttaacccggaaacccgggtaaacccccggtaaaccccgggtaacccccccgttaaaacccccggttacccggtttacccggtaaccccgttaccccgttttaacccggtttacccccggttcccccctttaaacccccgtttaccccttacccggttaaacccgttttaacccgttaacccggtttaaccgggtacgggtaacccggggttaccgggtaccggttaccgggaaccggttaaccgggaccgtaaccgtaggttaccgacgtcgcgacngtac

SEQ ID NO: 199349 - DNA, 337 bp, Homo sapiens
  misc_feature: GYAE6OF02JO2XQ.18.59.F04.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (323)..(337): a, c, t, g, unknown or other
  misc_feature (323)..(337): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagcccaccctcagcgtctcggggacccccgggnagagggtccaccatctcttgttctggaancagctcaacatcggaagtcagcccaagcctcgccccctggtcactcgtcgttcccgccctcctccatctcgtactgagcgggctcggacaggcacatagnnnnnnnnnnnnnnn

SEQ ID NO: 199350 - DNA, 638 bp, Homo sapiens
  misc_feature: GYAE6OF02INWBY.18.59.F04.1.454.CMB.1.raw
  modified_base (293)..(293): a, c, t, g, unknown or other
  misc_feature (293)..(293): n is a, c, g, or t
  modified_base (513)..(513): a, c, t, g, unknown or other
  misc_feature (513)..(513): n is a, c, g, or t
  modified_base (632)..(632): a, c, t, g, unknown or other
  misc_feature (632)..(632): n is a, c, g, or t
  modified_base (635)..(636): a, c, t, g, unknown or other
  misc_feature (635)..(636): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagccacccaggcaaacgccccccaaactcatgatttatgatgtcactaatccggcctcgagggttctaatcgcttctctggctcaagtctggcaacnccggcctccctgacctatctcgtcgggcctccgaggtctggacggacgaggctagtatttattacgtgtcagtcctacattaacgtacaacggccaaccgaggtcctaacgttcttacgtagttacgtccgttacggaacgtacgggaaccgtacgggtaccctaccggttaccgtacggttacccaaccgaccccggtaaacgacccccgtaaaccccncttacgtccctaaccgttccgtccgttcccccgtccctccccttaccgtaccttaaccgttccgttacgtcggaccggtccgggcgtaccggaccgtacgggccgaaccgtatacgctncgnncg

SEQ ID NO: 199351 - DNA, 593 bp, Homo sapiens
  misc_feature: GYAE6OF02FWB45.18.59.F04.1.454.CMB.1.raw
  modified_base (313)..(313): a, c, t, g, unknown or other
  misc_feature (313)..(313): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggtcgttgggtaaacggccgggggggttcccttagacctccccgtgtacacgcctctggattcactttcagtaagcctggatgaactgggtccnccgaggcctccgaggggaacgggctgggaggtgggtggaccgtaagttaaaaccaaactgagtgggaggacaacagactacgctgccaccgtagaacgcagtatcacatccanagagatgattaacgaaancacgctagtattganaaancgaacnacagacgaacgagaacacgagccgtagttactactcgtaaccactacctacccgagaaccgtcgtaaccaacctacctactaaccgtacgttacgtcggccttacggacgggtacccgaacggg

SEQ ID NO: 199352 - DNA, 569 bp, Homo sapiens
  misc_feature: GYAE6OF02GKKSW.18.59.F04.1.454.CMB.1.raw
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
  modified_base (442)..(442): a, c, t, g, unknown or other
  misc_feature (442)..(442): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (550)..(569): a, c, t, g, unknown or other
  misc_feature (550)..(569): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaacgccccccaaactcatgattttatgatgtcagtaatcggccctcgaggggtttctaatcgtcttctctggctccagtctggcaacnccggccctccgngaccatctcgtgggcctccaggctggacggacgaggctagtatttacttacngtcagctacattataacaacgccacccagctacctctacctntcgttcttacgggaacgtcgggaacctacggtcctacccgttactaagtcaccgacccgaacggacccctacccctctcgtaccnccttaccgttccgttcccccgtccccttcctaccccacttaccgtccgtaccgttacgccggtacgggtccgtaggtaccggacggtccgacgtagttacngtcngcnnnnnnnnnnnnnnnnnnnn

SEQ ID NO: 199353 - DNA, 667 bp, Homo sapiens
  misc_feature: GYAE6OF02I9OZ3.18.59.F04.1.454.CMB.1.raw
  modified_base (389)..(389): a, c, t, g, unknown or other
  misc_feature (389)..(389): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaaggccgggggggtcccttagacctccccgtgtacagcctctggattcactttcgagtaaggcctggatagaacgtcgggccgccgaggctccgagggacggggctggagtgggttggacgtaacttaaaccgaaactgatggtaggacaacagactacggntcgccgtacgtaggaaacgcagtactaccacactactacaaggtagaacgtagacttaaacgaaaacgcctaacggtactagttacacttaggaactaaagtacgaaacgtcggacctaggaaaccgaaccggaggtaacaccgtaacggccttacggttacttacgtacgtaaccctacgacttaccccgtaagaaccgtcgtaaccgtaacttaacgttaacctaacgttaacggtagcggtaacccgtcgggtaccgggaccggaacggtaaccg

SEQ ID NO: 199354 - DNA, 977 bp, Homo sapiens
  misc_feature: GYAE6OF02I52CI.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattccctcaccctcctcactcagggcacagggtcctgggcccagtctgccctgactcagcctcgcctccgtgtcgttgggttcctccgtggactagtcgatcaccatcctcctcgcacgtacggaaccagtcagttcgtacggttggtacgttaatactatgtctccgtacggtaccaacgacgtccaacccgagtaacccaaacccgtacccccctaaactccgaattacggttaacttttagtacgtaagtttccgtaactaaaccgttacggttaccccggtacccccgttaaggggttaaaccggggtttttaacctaacggttccccggtttactttccggttcccgttaccgggggtaccctttaaccccggtaaaggttttcccggaaccgggtaaccgttaaacccgggtccccgggtacccccccttttccgaacccggttaacccttaacgttacccggttcgggttcggggtaaccctccgggttaaacggggccgttaaacggggggtaacgggtacccggggtaaccgttcgtttaaacggttaagttttacccgttaacgttcgaacccggtagttcccgttaaacttaaccggtaaacgttaaaccaacccggttacccgaacgttcccggtaacttaccccgtttaccccggtttaagtttaaccttttacccgggggtaaccgtttttaaccggggaaaacccggttttcccgggggaaaaaccctttacccgggttaccccgggttaaaaccccgttttcccgggtaaacggttcccggaaaacccccgggttaaacccccggtaacccggtaaccccccccttaaacggttttttaaccccccgg

SEQ ID NO: 199355 - DNA, 532 bp, Homo sapiens
  misc_feature: GYAE6OF02JELFN.18.59.F04.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (327)..(327): a, c, t, g, unknown or other
  misc_feature (327)..(327): n is a, c, g, or t
  modified_base (516)..(516): a, c, t, g, unknown or other
  misc_feature (516)..(516): n is a, c, g, or t
  modified_base (519)..(532): a, c, t, g, unknown or other
  misc_feature (519)..(532): n is a, c, g, or t
tcagtacgagtatgcacgaccggtgctcgatttagtacacacacttagggattgggggctttgcctgggtgctgttggtaccaggagacatagttataaccaccatctcctgcactggaaccagcagtgacgttggtggttataactatgtctcctggtaccaacagcacccaggcaaagcccccaaactcatgatttangatgtcactaatcggccctcaggggtttctaatcgcttctctggctccaagtctggcaacncggcctccctgaccatctctgggctcccaggctgaggcgaggctgattatacgtgcagctcattanacagtccacagctactctctatgtctcggactggaccagtccaccgtcagtccacgccgaacgcccaacccactgtccacttcttcccgtcccctaccccttcctacccgtaacttacccttaccggtactcggaacggtcccggggtacttacgggaccgtaggcccgaccgtaattcggctagctgnacnnnnnnnnnnnnnn

SEQ ID NO: 199356 - DNA, 803 bp, Homo sapiens
  misc_feature: GYAE6OF02JMQK3.18.59.F04.1.454.CMB.1.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcagggcacgacgggtcctcgggcccagtcctggcccctgactcacgtcctgcccttccgtgtcgtgggtcctccgtggaccagtcgatccaccgattcctccgtgccacgtcggaaccngacngtgtacgttggtgttataactntgtctccgtaggtaccaacgagaccaccgtaggaccgtaaaccgaccccctaaacgtacctagtacggttattttaacgtagtacgttcgtaacctaaccgttaactcccggtaccccgttaggttaaccggggttttaactaaccgttaccgttccgttccgttcggttaccgtaccgttaccgtaaccgtacgttcggtaacctaaccgtacccggtccccttacccgtacgaccctaacgttcgtaccgtccgggtactcccggtagtaccggttaaggacgggtaaccggtacgtccgttaacggttaagtttacgtttaccgtcgtaccacggtaccttacgtaacgttaacgttaaaccaaccgtaccaaacggtacccaccgttaaccttacggtactttcgttaccgttaccgttaacggtaaccggtaccgggttaaacgtacccggtacccttaccggtacccgtaacgggttaccaacccgggtaccccgtaaacccggtacccctacccgtacg

SEQ ID NO: 199357 - DNA, 672 bp, Homo sapiens
  misc_feature: GYAE6OF02JJM22.18.59.F04.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (313)..(313): a, c, t, g, unknown or other
  misc_feature (313)..(313): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgacctcagcctgcctcgtgtctgggtctctggacagtcgatccaccatcctcgtgcactcggaaccagcagtgacgttggtagttanaactntntctctagtacaactgccaccacggacaaacgtaccccaaactcatacgtatttantatcgtactaactaactccggcccttaacgtacgggtttactaaatccgtcttacgtcttacggtcctactaacgtcgtcggaactaaccgaccgtccctccctacgtaccacttccgtacggttcggacctaccgtcggacgttacggacgggaacggagggtacctagttaacgttaactttacgtagtcctaaaggtcctacgttaaactactaaaccgaagtcaacggtacacgtaactacctaacgttaacggtacctttaaccgggataacccggggtaactaacgggtccctaaccgtaccgttacggaccgtacgacccggtaacccgaccgtaaccccgtacttaaccgg

SEQ ID NO: 199358 - DNA, 654 bp, Homo sapiens
  misc_feature: GYAE6OF02FW7XV.18.59.F04.1.454.CMB.1.raw
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggtaaaggccggggggtcccttagacctcccctgtacacgcctctggattcactttcagtaacggcctggatgactgggtccgcaggctccgagggagggctggagtgggtggccgtaataaaaccaacgtgatggtaggacaacgagactacgctgcacccggagaaacggcagacttacacctatctacgaaganagtnattaacaaaagccaacgctagtatactagactaaagacgaacacgtaccagaacggaaaccggaacggtaaccaacgacggtaccgttagttaacgtttaaccgtacgtaacccaaccgtacccgttaccccgtaaaggtaaacccgtaccgttaaccctaaaccttaacccgttaaccgttaacccgttaaccgggttaacgtaccggtacccgttacccgggg

SEQ ID NO: 199359 - DNA, 779 bp, Homo sapiens
  misc_feature: GYAE6OF02JCRUD.18.59.F04.1.454.CMB.1.raw
tcagtacgagtatgcacgaccggtgctcgatttagtacacacacttaggattggggaggagagacccctcccctcgggatcctcgggcccacgtctgccctgactcagcctgcctccgtgtctgggtctcctggacatcgatcaccatctcctgcactggaaccagcagtgacgttggtgttatactatgtctctggtaccaacagcaccgagcaaacgaccccaactcactgtatttatcgatgtctaagtaatccggtcccgtcgtaggggtttctaagtccgtcctttctcgtcggtctccctaagtcgtgaccaaccgaccgcccgttcccacgtaccgattcctacgtcgggtcctccgaggtacctggaaccgggtacggcggtaccgtgttaaccgtttattaaccgttcggactacgaccgttcgtaaattacctaaacgaacgccgacggtaccgaacgtccaacccgtacgtaacgttccgggttaaccggtaaaccggtaccggggaaaccgtaacggttacccgtaacccggttaccgttaaccgggttccgaacccgttaccccgggaaacccggtacccccgaaacccctaaccggttccgttaaccccggtaccttacccggtttccccgttaaacccctcccccgttacccttacccggtaaccctttaccgtacccggttaccgttccggtaacccggggtaccggtcccgggtccggaaaccgtaccgggtacccgtgtaacccgttacgacggtactcta

SEQ ID NO: 199360 - DNA, 573 bp, Homo sapiens
  misc_feature: GYAE6OF02GC7E9.18.59.F04.1.454.CMB.1.raw
  modified_base (232)..(232): a, c, t, g, unknown or other
  misc_feature (232)..(232): n is a, c, g, or t
  modified_base (484)..(484): a, c, t, g, unknown or other
  misc_feature (484)..(484): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtggttatactatgtctcctgtaccaacagcaccgagacaaacgacccccaactcatgtaatttatgatgtactactaacgtccggtccctcgtacgggttactacgtcgtcttctcgtcgctaccgtagtcgtcgaccaaccgaccggtccctaccctacgtacctactctcggtcgggcctacggacggtctacgggaacggacgacggtcttagtatttactacgtcgctacgctanatactaacgacgtacactacgactactctactagtcgtcgtacgacgtcggaacgacgtcgtacgtcgtacgacacgaccgacgtaccc

SEQ ID NO: 199361 - DNA, 757 bp, Homo sapiens
  misc_feature: GYAE6OF02JHC4B.18.59.F04.1.454.CMB.1.raw
  modified_base (233)..(233): a, c, t, g, unknown or other
  misc_feature (233)..(233): n is a, c, g, or t
tcagtacgagtatgcacgaccggtgctcgatttagtacacacacttagggagttgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcactaatccggccctcgacggggtttctaatccgtctttctcttggcctccaagtctggacaacgaccggccctccctagaccagtcctcgtcgggcctccgaggtctaggaacgggacgacggtctaggtaatttacttacgtggaccagtactacaattaactaacgaaacgtaccaaccaaggcctacgttaccttacgttaacttcggttacgttttaacccgggaacttacggggaaaccctaaacgggttccgtaaccccggttaccgttagggtacccaacccggaccccgaaacgggtacccccaaaccccgtacgttaccggtacccttaaccgttccccgtttaccggtttaacccccctacccccgtttaccgtacccctaaacgtttaaccccgttaccggttaaaccgttccgggacgggtacccggggtccgttaaccggggaaccggaaacccgggtcccgtaccgtaaccggtttaacggcccgttagtaccgacgtcgtacg

SEQ ID NO: 199362 - DNA, 712 bp, Homo sapiens
  misc_feature: GYAE6OF02F17O9.18.59.F04.1.454.CMB.1.raw
  modified_base (312)..(312): a, c, t, g, unknown or other
  misc_feature (312)..(312): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtggttataactatgtctcctggtaccaacagcaccaggacaaacgcccccaaatccatagtatttangatcgtacactaacgtccggccctacggtagggtttctaagttccgtacttctcgtcggtcctaccgtaagttcgtaggaccaaccgaccgggtcccttcccgtcgaccctacttccgttaccgtcgggtcccctaccggacgggtcgttacgggaacggggaaccggtacgggtacgttagtaacttttacgttaccgtcgaccgtacggtcctactaacgttactaaacgacgtacccaaccgtaaccgtacctaaccttccgttaccttacggttccggtttaccggtttaaccgggtaacccggttacggggtaaacccttaaccgggttacccgtacccggttaccggttaaccgggtacccgtaacccggtacccccgaacggtaacccccccg

SEQ ID NO: 199363 - DNA, 762 bp, Homo sapiens
  misc_feature: GYAE6OF02JFC77.18.59.F04.1.454.CMB.1.raw
  modified_base (203)..(203): a, c, t, g, unknown or other
  misc_feature (203)..(203): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacngtcgatcacctatcctcctgactactcggaaccagccgagtacggtacggttgggttagttaataacgtatcgttcctcctaggtaaccaacgacgacccacccgacggaccaaaacccgacccccaaactaccataggttatttagtagtacttacgtactaacgttaacgtcccgtcccgttacggttagggtttacctaagtccgttcttctaccgtcgtaccttaccgaacggttcctacgggtaccaaacccgacccggtcccctttacccgacgtaccctacgttccctacggtcggtacccgttccgtaccgggtcgttacggggaacgaccggtagtacgttacgttaactttaaccgttccgtaccgtcgtacgtactaacgtaacttacaaacggaactaccgaacccgtaacgtccctacttacctacgttacgttccgttaacccgggttaaccggtaaccggttaccgggaaaccccggttaacggtacccgttacccggttaccgtaccggtacgtaaccccggaccccgacccgtaaacccccg

SEQ ID NO: 199364 - DNA, 640 bp, Homo sapiens
  misc_feature: GYAE6OF02JYZ2W.18.59.F04.1.454.CMB.1.raw
  modified_base (235)..(235): a, c, t, g, unknown or other
  misc_feature (235)..(235): n is a, c, g, or t
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacagggtcctgggcccagtctgccctgactcagcctgcctccgtgtctgggtctccgtggacagtcgactcaccatctccgtgcactggaccagcagtnacgttggngttataactntgtctctggtaccaacngcaccgagacaacgaccccaancatgattatgtatgtactaactaactcggtacctcgtacgggttactaacgtcgtcttctcgtcgccttacgacgttcgtcggaccaacgtaccgtcccgtaccctacgtaccgacttcccgtacggtaccggtccgacgtcgggtcgtacgggaacgtacggagtaccgtacgttaatttacgttacgtacgaccgtctaccgtactaacgtactacggactaccgacgtcacgtactaccgtacttacgtacgttaccgtaacggtacgtacccggaaacgttaccggtaccgtacccgtaacgttacgttaccgaaccggacccgtaccgtacccgacccgtacg

SEQ ID NO: 199365 - DNA, 749 bp, Homo sapiens
  misc_feature: GYAE6OF02HNPRX.18.59.F04.1.454.CMB.1.raw
tcagtacgagtatgcacgaccggtgctcgatttagtacacacacttagggattggggtctgggagaggagccccagcccttgggattcccaagtgttttcattcagtgatcaggactgaacacagaggactcaccatggagtttggctgagctggtatttcctgctgcttagttttaaaggtgtccagtgtgaggtgcgagcgtggtggagtcggtagggggagtcgttagggtaaacgggtcccgggggggttacccttaggaccctcccccgtgtaaccgacgtccctgtcggtacttcgtacttttacgaagttaaccttactactagtcggtaccttaggactcccggcctaagggtccctaccgggaagggggacggggtcgtacggggtaacgtaccgtactacgtaacgtactacgtacgaacgtaaacctaacgtaaggtaaaactacctaagttaacctaacccgtacgaactaacggtaccttcggtaggttacgggacggggtacctaacgttccgaacctcgtaccgacccggtaggaaaccctacggaacccaaggtacaccgtaccaactacgttaacgtcctacgacgtacgaactcgtaccgtcgtccgtagtaccggaccggccggtaacgtccgttaccgggtttaccttacgacgttggaccggtagacgtacggaccgttccggacgtacgtcgtcgtacggacccgtacggtgttacgtacgttaccg

SEQ ID NO: 199366 - DNA, 777 bp, Homo sapiens
  misc_feature: GYAE6OF02GGBU7.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctcgccctgactcagcctgcctccgtgtctgggtctcctggacagtcgatcaccatcctctgcactcggaaccagctagtgtacgttggtagttaataactatgtctcctaggtaccaacagaccaacccgaggaccaaaccgacccccaaactcatgtaatttatagtatgtacctaactaacgtccggtaccctacggttacggggtttacctaacgttcgtactttccttcgttcggtacctaccgtagtccgtacggaacctaaaccgacccggtccccttaccccgtacgtaacccctacgttccgtcggttaccgggtaccctaccggtacgggtacgttacggggaacgggtaccggtacggtacggttaggttaaacttttacgttaacggtcgtacgtaacgtccttaactaaacttaacgtaaaccgaaacgtacccgaacctaacggacccttaaccgttacttaccgttaacgttccggtttaccgttaaccgggtaacccgggtccgggtaaaacccgttaccgggtaccccgtaacccggtttaaccgttacccggtacctaaaccccggtaacccggaacccggtacccccaaccccgttaccg

SEQ ID NO: 199367 - DNA, 738 bp, Homo sapiens
  misc_feature: GYAE6OF02FHLQS.18.59.F04.1.454.CMB.1.raw
  modified_base (241)..(241): a, c, t, g, unknown or other
  misc_feature (241)..(241): n is a, c, g, or t
tcagtacgagtatgcacgaccggtgctcgatttagtacacacacttagggattgggggggggtctcaggaggcagcgctctcgggacgtctccaccatggcctgggctcgtgctattcctcaccctcctcacctcaggcacagggtcctgggcccacgtcgtcgaccctgacgtcagcctgcctccgtgtctgggtctcctggacagtccgatcaccatctcctacgctactcggaacccngaccaggtacgacggtttggtcggttataaccttagttgtccttacctggttaccaacacgtccaacccgtacggaccaaaacggcccccctaaaactccaagtcgatttactcgtatcgtactactaacgtccggtccttcgtacggggttttccaaacgttcgggttcttccgtctacgggtccttacccgaacggttcgtacgggtcctaaacccgaccgggtacccctcccggttagaaccccacgttaccgtccgttcgggacccttcgaaccgggtcctagggaaccggtacggacggctaggtacttaacggttactgactcgactacgtacttaacacgaaactccgtaaccacgtacctaaactccgttaacttcgtaccgttaccgtaccggtaaccggttcgggaacccgtaacgggtaccctaccggttacccggtaacgtaccgtacccggtaccccggaacgacccccgaaccgttaacccgg

SEQ ID NO: 199368 - DNA, 489 bp, Homo sapiens
  misc_feature: GYAE6OF02HOQ9R.18.59.F04.1.454.CMB.1.raw
  modified_base (311)..(311): a, c, t, g, unknown or other
  misc_feature (311)..(311): n is a, c, g, or t
  modified_base (406)..(406): a, c, t, g, unknown or other
  misc_feature (406)..(406): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (462)..(462): a, c, t, g, unknown or other
  misc_feature (462)..(462): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (473)..(478): a, c, t, g, unknown or other
  misc_feature (473)..(478): n is a, c, g, or t
  modified_base (480)..(489): a, c, t, g, unknown or other
  misc_feature (480)..(489): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctgcaacacggcctccctgaccatcctctgggctccaggctggaggacgaggctgattatactgcagctcatntacaagcaccagcactctctatgtcttcggaattgggaccaggtcaccgtcctaggtcacgcccaaggcccaaccctctctcactctcgttcccncctcctccataccttcgtacngtacgccgggtntcgggacaaggccgtacagtagntnctgcancgnnnnnncnnnnnnnnnn

SEQ ID NO: 199369 - DNA, 701 bp, Homo sapiens
  misc_feature: GYAE6OF02GLLL4.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatccaccattctcctgctacgtcggaacctagcgagtcgtacggtttggtacgttaataacttagtcgttccttccgttaggtaacccaacgacgtaccgaaccccgaggaccaaaaccggtaccccccaaaactccgtaagttacgttaacttttacgtacgtaagttacggtacctaacgttaacgtcccggtacccgttacgggttaacgggtttactaacgtccgttccttcgtcgtcgtaccctacgtaacgttcgtacggactaaccggtaccgtcccttaccgtacgtacctacttccgtcgtaccgggtcctaccggacggtcgtaggacggtacgcgtcgtacgttattacgtacgtcgactacgtctagaactacgtacgacgtacctacgacgtacctactctactacgttcgttacgtacgtacggtcggaaccgtacggtccgtacgtacgtacgtaccgaccgaccgaccgtaccccacgtacg

SEQ ID NO: 199370 - DNA, 633 bp, Homo sapiens
  misc_feature: GYAE6OF02IFNRV.18.59.F04.1.454.CMB.1.raw
  modified_base (473)..(473): a, c, t, g, unknown or other
  misc_feature (473)..(473): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcacatctctgcactggaccagcagtgacgttggtgttataactatcgtctcctggtaccaacagcaccaggacaaacgcccccaaactcactacgtatttagtgatcgtacactaacgtccggccctgtacgggtttacaagtcgcttctctggcctaccgagttcctagggaccaacgaccggtacccttcccgtacgacccaacttccttcgtcgggtacctccgaaggcctggaacggacggtagccgttaggactttaagtttacgngtacgacgtctacgtaattaactaactaacgcctaaccgagtacctaacttcgtactaagttcgtaccgtttaccggaacgttacgggaaccgtaaggtccctaacccggtaccttagggtacccaccggtaccccaaacggtacccccaaaccccttcg

SEQ ID NO: 199371 - DNA, 598 bp, Homo sapiens
  misc_feature: GYAE6OF02I3DIY.18.59.F04.1.454.CMB.1.raw
  modified_base (127)..(127): a, c, t, g, unknown or other
  misc_feature (127)..(127): n is a, c, g, or t
  modified_base (197)..(197): a, c, t, g, unknown or other
  misc_feature (197)..(197): n is a, c, g, or t
  modified_base (234)..(234): a, c, t, g, unknown or other
  misc_feature (234)..(234): n is a, c, g, or t
  modified_base (261)..(261): a, c, t, g, unknown or other
  misc_feature (261)..(261): n is a, c, g, or t
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
  modified_base (472)..(472): a, c, t, g, unknown or other
  misc_feature (472)..(472): n is a, c, g, or t
  modified_base (575)..(575): a, c, t, g, unknown or other
  misc_feature (575)..(575): n is a, c, g, or t
tcagtacgagtatgcacgaccggtgctcgatttagtacacacacttagggattggggggggtctcaggaggcagcgctctcgggacgtctccaccatggcctgggctctgctattcctcaccctccncactcagggcacgagggtcctgggcccagtctcgccctgactcagcctgcctccgtgtctgggtcctccnggacacgtcatccgaccatcctcctgcactggaaccngctagcgtacgttggtgtaactaactntgtctcctggtaccaacacgccaaccgacgctaaaccgaccccaaactcgactgacttttatgtatcgtaccgacttacgtaccggtccccgtcggttaggggtttactaaacgttcgtccttcgttcgcggccttacgtactcgtcggccaacacggtccctacccncgacctatctccggcggcctcgacgntcggaaggcgaggtccngttacttacgttgcgtacgagtcctaagtctaactaacgcgtacacgctacctactcttactcgtgtccgtagacggtcgtaacgctccgtacgtcgtacganacccggcgtacgacccacgtacc

SEQ ID NO: 199372 - DNA, 707 bp, Homo sapiens
  misc_feature: GYAE6OF02J1AX4.18.59.F04.1.454.CMB.1.raw
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
tcagtacgagtatgcacgaccggtgctcgatttagtacacacacttaggtaggttgggggggggtctcaggaggcagcgctctcgggacgtctccaccatggcctgggctctgctattcctcaccctcctcactcgagggcacagggtcctgggcccagtctgccctgactcagcctgcctccgtgtctgggtctcctggacaggtcgatccaacctatcctcgtgactacgtacggaacctacgactagtcggttacggttagttaggttacttagtacgttcgtacctcgtacgtaaccaacgtccgacaaccgtacgacaacgacccctaagtcngtacgagttntagacgtgtaccgtaccacggttccgggtaccttcggtacggttactacgtactccgtcttacgagtcctacgacggtacgtccgtagaaccgttccgaccttaccgtcgtaccgttactacggttcgaccgtaccgtcggtaacggacgtacggtaacgggtacgtaacgggtcttagaacggtttacgtcacgggtacctacggttacctaaaccgttacgaaacttacgtaaccgtacgttaaccggtacgtaccgttaccgtaaaccggtcgtttacgaccgttacgaccgttacgtacgtaaccgcgtaaccgtcgtaccgtacgtacccacgtaccgccgtaccctccgtacg

SEQ ID NO: 199373 - DNA, 675 bp, Homo sapiens
  misc_feature: GYAE6OF02GWA2F.18.59.F04.1.454.CMB.1.raw
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (226)..(226): a, c, t, g, unknown or other
  misc_feature (226)..(226): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
  modified_base (265)..(265): a, c, t, g, unknown or other
  misc_feature (265)..(265): n is a, c, g, or t
  modified_base (531)..(531): a, c, t, g, unknown or other
  misc_feature (531)..(531): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccaggtctgccctgactcagcctgcctcgtgtctgggtctctggacngtcgatcacatcnctgcactggaaccngcagttgacgttggngttataactgtntctctgtaccancgcaccgaggacaaacgccccaaatcgatcgtatttagagactgtacaactacgtccgacccttaggtacgggtttacaacgttcgtacttctacgtcgcctacgagtttcgaggaactaccgtaccgtccctacccgttacgaacctcttcgtaccggttcgggacctccgaggtcctagggacggtaacggacgtcgttacgttaactttacgtttacgcgtatacgttccaacgttaagttaacacgaaccgccgtaaaaccncgtacttaaccgttaccgttagtaacttccggtttaccgtacccgggaaaacgttccggggaaccttaaccgggtcccgttaaccggaccgttttaacggacccggtaacctaaccccgggaccgtaaccccgtacccctacgg

SEQ ID NO: 199374 - DNA, 661 bp, Homo sapiens
  misc_feature: GYAE6OF02G8ZC0.18.59.F04.1.454.CMB.1.raw
  modified_base (228)..(228): a, c, t, g, unknown or other
  misc_feature (228)..(228): n is a, c, g, or t
  modified_base (269)..(269): a, c, t, g, unknown or other
  misc_feature (269)..(269): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtgttaataactatgtctctggtaccaanagcaccaggcaaacgcccccaaaatcatgatttatgatgtacaacttaatccggccctagtacggggtttactaactcgtcttcgtctggctacaagtcgtggaccaacgcggtcctccctgacctagtcctcgtgggcctcgaggtctggacggacgaggtctaggtaattaacgttactgacacgtacctataactaacgttaaccaacggtacctaacccgaggtaccctaaaccgtttccttaacccgttagttccggtttacccgtttaacgggtaaacccgttcggggtaaaccctaaacggggttccctaaccccgggtttaccgttaacgggtccgaaaccggtacccccgtaaaaccgggtcccctaaacccccggttaccgg

SEQ ID NO: 199375 - DNA, 635 bp, Homo sapiens
  misc_feature: GYAE6OF02F5UUH.18.59.F04.1.454.CMB.1.raw
  modified_base (270)..(270): a, c, t, g, unknown or other
  misc_feature (270)..(270): n is a, c, g, or t
  modified_base (454)..(454): a, c, t, g, unknown or other
  misc_feature (454)..(454): n is a, c, g, or t
  modified_base (510)..(510): a, c, t, g, unknown or other
  misc_feature (510)..(510): n is a, c, g, or t
  modified_base (545)..(545): a, c, t, g, unknown or other
  misc_feature (545)..(545): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaaggccgggggggtccttagacctcccctgtacagcctcnggattcacttcagtaagcctggatgaacgtgggtccgcgaggctccgagggaacggggcgtggaggtgggttcggaccgttaattaaaaacccgaaaactggaagtgggtagggaacaacgacgactacgctgccgaccggtagaaacggcgaagtattacccgaacctatcctacaacggtanacgtagaattaacaaaaacgctaacgacttagtaactcgtagaactaaatcgaaancgtacctagaacgtaaaccgagacacgagaccgtntaactactacgaccacactacccgtagaacgccgtaacaacttaaccgtaactacgtacggtactaccggtacctacggtcgggaaccgg

SEQ ID NO: 199376 - DNA, 667 bp, Homo sapiens
  misc_feature: GYAE6OF02G78V3.18.59.F04.1.454.CMB.1.raw
  modified_base (182)..(182): a, c, t, g, unknown or other
  misc_feature (182)..(182): n is a, c, g, or t
tcagtacgagtatgcacgaccggtgctcgatttagtacacacacttagggattggggggggagaggagccccagccttgggattcccaagtgttttcattcagtgatcaggactgaacacagaggactcaccatggagtttgggctgagctggattttccttgctgcttattttaaaaggtntccagtgtgaggtgcagcgtggtggagtcgtgggggaggcttagggtaacggccggggggtccttagacctcccctgtacacgtcctctggtattcactttcagtaacggcctaggactgtaacgtcgggtcccgcacggtctaccggaggggaacgggcgtgggaggttggggttcggaccgttaaataaaaccgaaacgtgagtaggtaggaacaacgacgactacgctgaccgaccgtagaacgcagataccacctatactacgaagtaagactagtaacttaaacgaaaaacgctaacgtacttagtactactaacgacctaaaagtacgaactacgacgtagaacgaccggagacgtacacggtactagttacgtacctacgtaccactaccaccgtacgaacggtcctaactaacgtacctaaccgtaacgtacggtaactccggtaccttacgggtaccggtaccgaaccggtacccg

SEQ ID NO: 199377 - DNA, 1004 bp, Homo sapiens
  misc_feature: GYAE6OF02I1ZUY.18.59.F04.1.454.CMB.1.raw
  modified_base (655)..(655): a, c, t, g, unknown or other
  misc_feature (655)..(655): n is a, c, g, or t
  modified_base (762)..(762): a, c, t, g, unknown or other
  misc_feature (762)..(762): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttggctgagctggattttcctgctgtctatttaaaggtgtccagtgtgaggtgcagctggtggagtcgtgggggagtcgttagggtaaacggccgggggggttcccttaggaccttccccgtaggttacgacggtcccttcgtacggtacgtttcctaaccttttccgtaagggttaaacggtccccgttagggtaacttacgggtaaacccggttgggggtacccccgtacccggttaaacgggcccggttacccggaacgggggggtaaacgggggtaccgttaggggggttaaacgggtttcggggggttttacggggtaaccccggtttaaaaacggtttttaaaaaacccccggaaaaaacggttttcgggtaacggttacggggtttaacgggggaaacctaaaacggtacggaaaccggtttaaccgaccgtttacggacccgaacccgggttaaggaaaacgggactaaacggtactttaacccgaaccgtacttacccggttaanaaacgggtacgtaaagtacggttaaacttaaaccgaaaaaacggtccgtaaccgtaacttcgggttaaactaccgttaacgggaaacctaaagtccgggttaaaacnccggttacccgtaagtaaaaccgggaacccggtaaggtaacccggaactacgggttaaccccgttaagtttaacccgttaaaccgggttaccctaacgttaaccctaaccgttttaccccgggaaaccggtaaaacccggttacccggtaacccttaaaacccgttaccccgttaaacgtttacccggtaaaccggtttactaacgggtaaccccctttagggggcgggttaaaacccccgg

SEQ ID NO: 199378 - DNA, 157 bp, Homo sapiens
  misc_feature: GYAE6OF02IMT7U.18.59.F04.1.454.CMB.1.raw
  modified_base (137)..(157): a, c, t, g, unknown or other
  misc_feature (137)..(157): n is a, c, g, or t
tcagtacgagtatgcacgaccggtgctcgatttagtacacacacttagggattggggggctttgcctgggtcctgggcccagtctgccctgactcacgcctgcctccgtgtctgggtctcctggacagtcgatcacnnnnnnnnnnnnnnnnnnnnn

SEQ ID NO: 199379 - DNA, 558 bp, Homo sapiens
  misc_feature: GYAE6OF02G357N.18.59.F04.1.454.CMB.1.raw
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (351)..(351): a, c, t, g, unknown or other
  misc_feature (351)..(351): n is a, c, g, or t
  modified_base (545)..(545): a, c, t, g, unknown or other
  misc_feature (545)..(545): n is a, c, g, or t
  modified_base (552)..(554): a, c, t, g, unknown or other
  misc_feature (552)..(554): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccccaaactcatgatttangatgtcactaatcggccctnaggggtttctaatcgcttcnctggctccaagtctggcaacacggccctccctgaccatctctgggctccgaggctggaggacgaggctgatttattacngcagctcaatacacaagccaacagcctactctctatcgtcttcggaactcgggaccaaggtccaccgtacctaagttccacgacccaacggccctaacccgtctacgtcctacttcgtccgttccccgtcccctcctactactacgtacctggacgccgggactcgggaccgtacggccgtacgtagttacgcncgtacgnnngtac

SEQ ID NO: 199380 - DNA, 844 bp, Homo sapiens
  misc_feature: GYAE6OF02HMTCF.18.59.F04.1.454.CMB.1.raw
  modified_base (193)..(193): a, c, t, g, unknown or other
  misc_feature (193)..(193): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtgttataactatgtctctgtaccaanagcaccaggacaacgaccccaactcatgatttatgatgtcaactactccggtcctcgtagggtttactaacgtcgtacttccgtcgtaggcctaccgaagtcgtacggacaaccgaccggtcccttcccgtacgtacctacttcgtacgtcggtacctaccggacggtcgtacggtaacggacggtacggtctgtaactttacttacgtacgcgtacgtacctacgtaacttaacgtaaccgtaacgtacccaaaccggtacgtacccgtacctttaccctttacgttacgttacgtttaccggttaacccgggtaacggtaaccgggtaaacccggtaaccgggttacccgtaaccccggttacggttaaccggtaacccgggacccgtaacccggtaaaccccgtaaccccgtaaacccccgtacccggttaccgttaaccccgttaacccgttaccccgttaccccgtttaaccccccgtaccccgtttaacccgttaacccttaaaccggttaccccgttttaaccgggtaacccgttacgggtaaccccggggttcccggggtaaccggtaccgggtaacccggtaaccgggtacccggtaaccgttaaccggttacgggactacggtacgttacgacgtaaccgg

SEQ ID NO: 199381 - DNA, 666 bp, Homo sapiens
  misc_feature: GYAE6OF02HN1LB.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccaggtctgccctgactcagcctgcctccgtgtcgtgggtcctccgtggacagtcgatcaccatctcctgctacgtggaaccagctaggtgtacggttggtaggttaataactatgtctccgtcggtaccaacgacgaccacccaggaccaaaccgacccccaaactccatacgtatttagtagtatgtacctacgtaacgttccggacccttacgtacggggtttactaacgtccgttcttcctcgtcgctaccgacgttcgcgaccaacgccgtcctaccctacgacctactcgtcgtggtccgtaccgacgtcgtacgggacgacggacgtacgtagtaacttacgttacgtacgtcgtagtcctaactataactaaccgtaacggaccaaccgtcgactacctacttatacgttacgtaccgtaacggtacggtaacggaccgtaaccggtacctacccgtacgtacggtaccgaccgaccgaacccggtacccctaacccgtacccgg

SEQ ID NO: 199382 - DNA, 725 bp, Homo sapiens
  misc_feature: GYAE6OF02IJUNE.18.59.F04.1.454.CMB.1.raw
  modified_base (339)..(339): a, c, t, g, unknown or other
  misc_feature (339)..(339): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggtattttccttgctgcttatttttaaaaggtgtcctagtgtgaggtgcagcgtggtggagtcgtgggggagtcgttgggtaaacgggccggggggttcccttaggaccttcccccgtagtacgacgccctcgtcggtattccgtacttttcgaagttaacggcctaggaactggaacgtcggggtccnccgacggtacctccgaagggggtaacggggcgtagggtacggttggggttaggacccgttaaattaaaaacccgaaacgtggtaagttcgggtacgggtaacaaacgaggtaacctacggtctacggacccgtacccggtaggaaagtcgaagtaacttcgactactcgtacaagacgtatagtaacttaaacgaaaagctacgtctacgtactaccgtagaacgaaagtaccgaaacgcgtaaccgacggaaccgaacggacgtaacgaacgtaccgtacgttagttactaaccgtacgtaaaccaccgtacttacccgaagtacgtacctactaaactcttacgtaactaggtactgtacccgtgacgggtaccgaacggtccg

SEQ ID NO: 199383 - DNA, 534 bp, Homo sapiens
  misc_feature: GYAE6OF02FTL3Z.18.59.F04.1.454.CMB.1.raw
  modified_base (407)..(407): a, c, t, g, unknown or other
  misc_feature (407)..(407): n is a, c, g, or t
  modified_base (458)..(458): a, c, t, g, unknown or other
  misc_feature (458)..(458): n is a, c, g, or t
  modified_base (470)..(470): a, c, t, g, unknown or other
  misc_feature (470)..(470): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagccacccaggccaaagcccccaaactcatgtattatgatgtcactaatcggcctcgagggttctaatcgtcttctcgtgctccaagtctggcaacacggcctccctgaccatcctctgggcctcgaggtcgngacgggacgcggctgatttattacgtgacagtctcatatacaacgcaaccngccatcctactntcgtaccgttacggacgtcgggaacctaggtcctacggtctacggtcacgcccaggtaaccccc

SEQ ID NO: 199384 - DNA, 808 bp, Homo sapiens
  misc_feature: GYAE6OF02H2PJZ.18.59.F04.1.454.CMB.1.raw
tcagtacgagtatgcacgaccggtgctcgatttagtacacacacttagggattgggggctggggtctcgaggaggcagcgctctcgggacgtctccaccatggcctgggctctgctacttcctcaccctctcactcgagggcacgtagggtccgtgggcccagtctcgaccctgactcacgcctgccctcgtgtcgtgggtctcgtggacaggtcgactcgacctatctactgcctacgtacggaaccagacgtaggttacggacggtttggttacgttaataacgtgttacgttccgtaccgttacggtaaccaacgacgtacccgaacccgaggaacccgtaaaacccggacccctaaacgttacgtaacgttagttaactttacgtcgtaacgtaccgttaacctaacggtaaccgtcccgggttacccgtaggttacgggttactaacgtccgttacttcgtcgtgtacctacgtacgtacgacggaaccacggccgtcctacgtaccggtactacgtacgttcgccgggttaccctacggacggtaccgtaacgggacgggtacggtaacgggtaccttaggttaaaccgtttacgttaccggtacgtaacggtacctacgtaaccgttaacgtaaccgtaaacgtaaccgtacccgtaacctaccggtaacttacccgttaacttcggttacttacgggtttaccgttaccgggaacccggttaacggtaacccgttaacggtacccgttaaccgtacgggttacccttacccggaacgggtaccccgtacccgtaaacccg

SEQ ID NO: 199385 - DNA, 597 bp, Homo sapiens
  misc_feature: GYAE6OF02I8ZIL.18.59.F04.1.454.CMB.1.raw
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (473)..(473): a, c, t, g, unknown or other
  misc_feature (473)..(473): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacagggtcctgggcccagtctgccctgactcagcctgcctcgtgtcgtgggtctctggacagtcgatcacatctctgcactcggaaccngcagtgtacggttggtgttatactntntctctgaccancncaccagacaacnccccaatcatgtattntgntntacactacgtcgccgttagtacggtttctacgtctcttcgtctcgtcctacgtagtcgtacgacgaccgacggtccctcctacgtacctctccgtcgtcgggtcctcgacggcgtacggacggacggtacgtcgtacgttaatttacgtctacggtcctacgtcctataacttanaacgacgacaccgtagaccgttccttaacgtcgttaacgttccgttacgtacggtaccgtcggtaaccgtacgtccgtaaccgttcgtaccgtaccgacgacccgtaacgaccctacgtaaccg

SEQ ID NO: 199386 - DNA, 617 bp, Homo sapiens
  misc_feature: GYAE6OF02G6W61.18.59.F04.1.454.CMB.1.raw
  modified_base (268)..(268): a, c, t, g, unknown or other
  misc_feature (268)..(268): n is a, c, g, or t
  modified_base (379)..(379): a, c, t, g, unknown or other
  misc_feature (379)..(379): n is a, c, g, or t
  modified_base (407)..(407): a, c, t, g, unknown or other
  misc_feature (407)..(407): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcacatctctgcactggaaccagcagtgacgttggtggtataactatgtctctgtacaacancaccaggacaaacgccccaaactcatacgtatttatgtatgtacactaacgtccggacccttacgtacggggtttactaacgtcgtctttacgtctcggctacgaagttcncggacaacgaccgcccgtcccagacctntcctcgtcgggcctccgacggtcgtacgggacggacggacggcgttagtaatttagttacgtcgtcctagtcctacgtaactaagtaaccaagacccaccgaagtcctaactccttatacgttcgtaccgttacggaccggtacggtaaccgtacgtacccgtaccgtccgtacggtccgaaccgacccgtaacgacccctaacctaccg

SEQ ID NO: 199387 - DNA, 735 bp, Homo sapiens
  misc_feature: GYAE6OF02ILCS2.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctcgccctgactcacgcctcgcctccgtgtctcgggtcctcgtcgacgagtcgactccacctactctcctcgcacgtacgacagctacgtcggtacggttggttagttaacttaacgtagttcgtcctaccgtacgtaaaccaacgacgccaaccgacggaaccgtaaaccgaacccccaaactaccacgtacgttaactttagtagtattcgtaactagtaaccgtccgacccgttacggttacgggttactacttccgtcttctcgtcgtactaccgtagtcgtcgtaccaaccgtacccgtacctcccgtcgtaaccctcgttctacggtccggtactccggagtcggtacgacgggtacgtacggtcgtacgttaactttacttacgcgtaactacgtactactaacttaacgaacgacgtacacggactaacctctaaaccgtttacgtaacgtttaccgggtaacgaaccgggttacgggtaaacccggtacgtaccccggttaccgttaaccgggtaccgacccgtaaccggtaacccccggaaccgacccccgtaacccgtattacccgg

SEQ ID NO: 199388 - DNA, 672 bp, Homo sapiens
  misc_feature: GYAE6OF02I33F1.18.59.F04.1.454.CMB.1.raw
  modified_base (289)..(289): a, c, t, g, unknown or other
  misc_feature (289)..(289): n is a, c, g, or t
tcagtacgagtatgcacgaccggtgctcgatttagtacacacacttagggattgggggggggtctcaggaggcagcgctcgtcggggacgtctccaccatggcctgggctctgctattcctcaccctcctcactcgagggcacgagggtcctgggcccagtctgcctgactcagcctgcctcgtgtcgtggtctcctggacagtcgaatcaccatctcgtagcacgtcggaaccagctagtcgacgtttggtaggttaaataactatcggtctcctaggttaaccaaanacgaccaaccgaggacaaacgacccctaaatccatacgtatttagcgtatcgtacaactaatcgtccctagtacgggttactaagtcgtcttacgtcgtggacttaccgaagttcgtacgaactaacgaccgtaccctccgacgtaaccgtatacgtcgtacggtcgtaccgtcggacgtacggaacggacggacggtaacgtgttaaacttagttaaccgttaggacaacgtctaacgaacgtttaacaacgaacgaccaacgtataaccgtcttaccgtaacttaagttcgttacctacggtaacggtaccggaacgtacgtaccgtaccgttacgtacggttaccgaacggaccccgtaaggacccctaaccgtaaccgg

SEQ ID NO: 199389 - DNA, 731 bp, Homo sapiens
  misc_feature: GYAE6OF02GY35L.18.59.F04.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctcgtgtcgtgggtcctccgtggacngtcgatcaccntctcctgcactacggaacngctagtgtacgttggtgttaatacttatcgtccttcgtacggtaaccacgacgccaacccgaggaccaaaccgaccccctaaactcatgtaactttatacggatcgtctaactaacgtcccgtacccgttacggttacgggtttactaacgttccgtctttcgtcgtcgtacctaccgtagttccgacggtaccaacgtcccggtccctacccgtacgtaccctaacgttcccgtcggttaccggccctaccgggtacgtcggtacgggtacggacggtacggtacttacgttaatttaccgttacgtcggtacctacgtcctaacgtacttaacgaaccgacgacctaccgacgtactaccgttctacgttacgttaccgttaccgttacggaccggttaaccgggtaacccgttaacccggtccgtacccgttaccgggttaccgtaccggtaccccgaacccggtacccccgtaacccgtaccccgttaacccgg

SEQ ID NO: 199390 - DNA, 636 bp, Homo sapiens
  misc_feature: GYAE6OF02FQYNP.18.59.F04.1.454.CMB.1.raw
  modified_base (279)..(279): a, c, t, g, unknown or other
  misc_feature (279)..(279): n is a, c, g, or t
  modified_base (415)..(415): a, c, t, g, unknown or other
  misc_feature (415)..(415): n is a, c, g, or t
  modified_base (471)..(471): a, c, t, g, unknown or other
  misc_feature (471)..(471): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtagttatactatgtctcctggtaccaacagcacccngacaaacgcccccaaatcatgatttatgatgtacaactaatcggccctcgtaggggttttctaatcgtcttctcgtggtctaccaagttctggacaacgacgtccctcccgtcgaccatcctcgtcgggctaccgnggtctggacgggacgtaggtacgtgtaactttacttacgtcgacgtacgccttaanacttacgtaacaacggaccaaccgtaacgacccgtaaccttcgttaccttacgttacgttccgttaccgggaaacggttccgggaaaccgttaacgggtcccttaacccggtaccgttaacggtccctaaccggaccccgaacgggtacccccaaccccgtaccg

SEQ ID NO: 199391 - DNA, 776 bp, Homo sapiens
  misc_feature: GYAE6OF02H2RUG.18.59.F04.1.454.CMB.1.raw
  modified_base (446)..(446): a, c, t, g, unknown or other
  misc_feature (446)..(446): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagcgtggtatttcctgctgctattttaaaaggtgtccagtgtgaggtgcagctggtggagtcgtgggggaggcgtttgggtaaaacgggtcccggggggggttacccctttaggtacccgtccccccgttaggtaccgacggtcccttcgttggtacttccgtaccttttacgaggtaacggccctaggtatggtaaccgtggtcccgccgaaggccttaccggaagggtaagggccgtgggaggttggggttacggccgttagtaagaagacgtaaacgctaaacgagttacgaccganagctagtagtgctagcgtacggtagaaacggcgtaggtcctacggtccgttacctaaaggtaaactggtaaacttaaccgaaaagaacccgtacgggtaacgtacgtacgtacgagtaaaatacgaacgacgtaccctaaacggaaacccggaacgggaacgaaccggaccggttagtaacttaacgttaacgtacgtaacggacggttacgggtagtaacttaggttacggtaggggttcggttaacggacggttaaccggggaaaccgggggttaaccgttaggacccgtacggttaaggtccgggtacggttccggtaacccggggg

SEQ ID NO: 199392 - DNA, 731 bp, Homo sapiens
  misc_feature: GYAE6OF02IBPHM.18.59.F04.1.454.CMB.1.raw
  modified_base (441)..(441): a, c, t, g, unknown or other
  misc_feature (441)..(441): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctccgtgtcgtggtcctcgtggacagtcgactccacctatcctcctgacctacgtacggaacccaggtccgtaaggttcggtaacggtttgggtaggtttaaacttaaacgttagttcgttcctccgttacggtaaccaaacgacgaccaacccgaggaaccaaaacccgacccctaaactctaagttacgtatttactggtatcgtactaacttaacgtcccggtaccgttcggtacgggtttactaacgttccgtccttntcgtcggtcctaccgtagtcgtacgacctaaccgaccggtccctcccgtacgacctagttcccgtacgtcgggtccctacggacggtccgacgggaacggcggtacggtacgttagttactttacgttacgtcgacgtctactactaatactacgacgacctacctacgcctaccgttctacgttacgttccgtaccggttaacgggaaccggttaccggtaaccgtaccggttcccgtaccggttacccgttacggacccgacccggaaccccgtacccgtaacccccg

SEQ ID NO: 199393 - DNA, 658 bp, Homo sapiens
  misc_feature: GYAE6OF02F8DYP.18.59.F04.1.454.CMB.1.raw
  modified_base (310)..(310): a, c, t, g, unknown or other
  misc_feature (310)..(310): n is a, c, g, or t
  modified_base (527)..(527): a, c, t, g, unknown or other
  misc_feature (527)..(527): n is a, c, g, or t
  modified_base (554)..(554): a, c, t, g, unknown or other
  misc_feature (554)..(554): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcaggcacagggtcctgggcccagtctgccctgactcagcctgcctccgtgtctggtctcctggacagtcgatcaccatctcctgcacgtggaaccagcagtgacggttggtgttataactatgtctccgtggtaccaacacgcaccaggacaaacgacccccaactcatcgtatttangtattctacgtactaacgtccggtacccttacggttacgggttttacctaacgtccgtacctttcttccgtcggtacctactaacgttcgtacggcctaaaccgaccggtcccctaccgtacgaacctctctacggtcggaccttcggaggtacgaggtacggacggaggtcctaggttactttaagttactgaccgtagtcctacgtataactaanacgaccgaacgtaccactccttacttntacgttcgtttacgaccggtaacgggttaccggaacggtaccggtaacccgttaccgtacgtaccggttaccgaccaacccggacccgtaccccgaccgtaccg

SEQ ID NO: 199394 - DNA, 872 bp, Homo sapiens
  misc_feature: GYAE6OF02FMJ8Q.18.59.F04.1.454.CMB.1.raw
  modified_base (859)..(859): a, c, t, g, unknown or other
  misc_feature (859)..(859): n is a, c, g, or t
  modified_base (867)..(867): a, c, t, g, unknown or other
  misc_feature (867)..(867): n is a, c, g, or t
tcagtacgagtatgcacgaccggtgctcgatttagtacacacactttagggagttgggggctttgcctgggtcctgggcccagtctgccctagactcagcctgcctccgtgtctgggtctcctggacagtcgatcaccatctcctgcactggaaccagcagtgacgttggtggttataactatgtctcctggtaccaacagccacccgaggacaaacgacccccaaactcagtgtatttagtgatgtaccaacgtaacgtccggtaccccttcggtaaggggttttaccttaaacgttccgttcctttccgtccgttcggtaccttaccgtaaacgttcgttacggacccgtaaccgtaccccgggtcccccttaccccgtaccggtaaccctacgttacccgttccggtacgggtccgtaccggtacgggtaccgttacgggaaccgggaaccggtaccggttacgttacgttaacgtttaacgttaccgtacggtacctacggtccttaactaaacgttaaccgtaaacgtaaaccgtaccctaaaccgtacgtaccctaacgttaccctttaaccgttcgggtttaccttaccgggttaaaccgggtaaaccggttaaccgggaacccgttaaaccggttacccctaacccccggttaccggttacgggtaacccacccggaaccccaacgggtaacccccctacccgtagtttacccggtcctacccggtttcccgttaccccgtttcccccacccgttaccgttaacccgttaccttaccggtacgttaccgtaccggacgggtacccgttcggtaaccggaccgtaccggaccgtaacgttagtccggtcganacggttcncgtcg

SEQ ID NO: 199395 - DNA, 868 bp, Homo sapiens
  misc_feature: GYAE6OF02HDOIV.18.59.F04.1.454.CMB.1.raw
tcagtacgagtatgcacgaccggtgctcgatttagtacacacacttagggagttggggggggtctcaggaggcagcgctctcgggacgtctccacatggcctgggctctgctattcctcaccctcctcactcagggcacagggtcctgggcccagtctgccctgactcagcctgaccttccgtgtcctgggtctcctggacagtcgatcaccatctcctgctacgtaggaaccaggccagtcgacgttggtacggttaataactatcgtctccgtggttaccaaacagaccacccgaggacaaaacgccccaaaactcagtcgaactttatcgaagtcgtacacgtaaacgtcgggtaccctacgtacggggttttacctaaagttccggtcttacgttacgtcggggaccttaaccgaaacggttacgttacgggaaccaaaccgtaaaccgggtccccgttaccccggttaacgggaacccttaaccgtttaccgttaccggttacggggtaccctttaacccggtaacgggaacccttttaggggaaaccgggttaaacgggaaaccggttaccggttaacgggttaaacttttttaacggttaacccgtttacgggacccgtaaacgggtacccttaaccgggttaaacttaaaccgttaaaacccggaacgtaccgtaaagggaaccccgtaaaggacccgaaacgttacccgtaaaagtttacccgttaaccgggtaaacggtaccggggtaaacccggtaaaccggttaccgtaaaccccgggttacctaaaggggttacccgaaccggttaaccccgggtaaacgggtaaaccccccaaaccccgttaagttaaccccgg

SEQ ID NO: 199396 - DNA, 405 bp, Homo sapiens
  misc_feature: GYAE6OF02JEJ84.18.59.F04.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (346)..(346): a, c, t, g, unknown or other
  misc_feature (346)..(346): n is a, c, g, or t
  modified_base (349)..(353): a, c, t, g, unknown or other
  misc_feature (349)..(353): n is a, c, g, or t
  modified_base (355)..(405): a, c, t, g, unknown or other
  misc_feature (355)..(405): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcccaccctcagcgtctcggggaccccccggnaggagggtcaccatctcttgttctggaancagctaccaacatcggaagtcacgcccaaggcctcgcccccctggtccactcgtgttccccacccctcctccatacctcgtactgacggcggtcgtggacacggcgcagtagctngtnnnnntnnnnnnnnnnnnnnnnnnnnnnnnnnnnnnnnnnnnnnnnnnnnnnnnnnn

SEQ ID NO: 199397 - DNA, 724 bp, Homo sapiens
  misc_feature: GYAE6OF02JPQZV.18.59.F04.1.454.CMB.1.raw
  modified_base (163)..(163): a, c, t, g, unknown or other
  misc_feature (163)..(163): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
  modified_base (656)..(656): a, c, t, g, unknown or other
  misc_feature (656)..(656): n is a, c, g, or t
  modified_base (665)..(665): a, c, t, g, unknown or other
  misc_feature (665)..(665): n is a, c, g, or t
  modified_base (717)..(717): a, c, t, g, unknown or other
  misc_feature (717)..(717): n is a, c, g, or t
  modified_base (722)..(723): a, c, t, g, unknown or other
  misc_feature (722)..(723): n is a, c, g, or t
tcagtacgagtatgcacgaccggtgctcgatttagtacacacacttaggagttgggggcgtttgccgtgggtcctgggcccagtctgccctgactcagcctcgcctccgtgtctgggtctcctggacagtcgatcaccatctcctgcactggaaccagcagtnacggttggtggttataactatgtctcctggaccaacagccacccaggacaaacgccccccaaaactcagtagtatttacgtgattacgtacaactacgtccggtccctacgtaggggttttaccttaagttcgtcctttccgttcgtcggtaccttacgaacggttctacgggacctaaccggccgtaccctttcccgcaccccttagtccttacggtcgggtcctcgaccggggtnttaggggaccggacggtacggtacttntaagtttaacttccggtatcacgtactttaccaagttacctaaccctaagccccaaactcccgactttactcggttaaccttcggttactttaccggtacggtaacgtacggggtaaaccgactacccggtacctccggtggacctaccgaccctaacccgggacctacccgcgtacgtacccttacgtcccttaccccgtacccttcccctcccttaacaccgttacncccgttacncgggcggtacccgtcggttacgaccgggtcggtaccaacgtacgtaaccgcngcacnnc

SEQ ID NO: 199398 - DNA, 689 bp, Homo sapiens
  misc_feature: GYAE6OF02I5X78.18.59.F04.1.454.CMB.1.raw
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (309)..(309): a, c, t, g, unknown or other
  misc_feature (309)..(309): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcacgcctgcctcgtgtctgggtctcctggacagtcgatcaccatcctcctncactggaaccagcagtgacggttggnggttataactntntctcctggtaccaacagccaccgagaccaaccgacccccaactccatagtntttatatactacgtactactaacttccgcccgttacgtagggtttacctaagtccgtacttccttagtcgtcctactacggtcttacggactaacgaccggtcccttacccgacgtacctacgtcgtccgtacgggtcctccgtaacggcgtaggacggggtacagggacgtacgttatttaacgttaccgtcgacctacggtacctacgtaactaactaccgaacgacacctacgacctaccgtaccttaactcgtttaccgttacgtaccgttaacccgggtaggtaaccccgtacgggttaccccaacccgggttttaccgtacccggtaacggtaccccgtaaacccggacccggaccccgttaacccccgtacgg

SEQ ID NO: 199399 - DNA, 590 bp, Homo sapiens
  misc_feature: GYAE6OF02IE4CF.18.59.F04.1.454.CMB.1.raw
  modified_base (153)..(153): a, c, t, g, unknown or other
  misc_feature (153)..(153): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (258)..(258): a, c, t, g, unknown or other
  misc_feature (258)..(258): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (571)..(571): a, c, t, g, unknown or other
  misc_feature (571)..(571): n is a, c, g, or t
  modified_base (573)..(575): a, c, t, g, unknown or other
  misc_feature (573)..(575): n is a, c, g, or t
  modified_base (580)..(580): a, c, t, g, unknown or other
  misc_feature (580)..(580): n is a, c, g, or t
  modified_base (584)..(588): a, c, t, g, unknown or other
  misc_feature (584)..(588): n is a, c, g, or t
  modified_base (590)..(590): a, c, t, g, unknown or other
  misc_feature (590)..(590): n is a, c, g, or t
tcagtacgagtatgcacgaccggtgctcgatttagtacacacacttagggattgggggctttgtctgggtctcctggacagtcgatcaccatcctcctgcactggaaccagcagtgacgttggtaggttataactatgtctcctggtaccaanagcacccaggccaaacgcccccaaactcatgtatttaatgatgtacaactagtcggccctgtagggtttcatcncttntctagctcaagtctgcacncgctcctnaccatcctgtcggctccgaggcgtgaggacgagtctagtaattatactgctacgctacatataacgagaccacagctactctacctagtcgttacttaccggaacgttcgggaacctaaggtccctaccgtcctaaggtccaacgcccgtaacgaccccaacccggttacctaccggtacctaaccgtccttacccgttccccgccccgttaccctaccgtaacttaccggttaaccgtacgtcggaccggtcggggtactaccgggtaccggaaccgtacggactaacggacgtcagtcgacncgncnacgngnnngctancacnnnnnan

SEQ ID NO: 199400 - DNA, 894 bp, Homo sapiens
  misc_feature: GYAE6OF02FUL4U.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttggctgagctggtattttccttgctgtcttaatttaaaggtgtaccagtgtgagtgcagcgtggtggtagtcgtggggaggtcgttagggtaaacggtccggggggtacccttagtaccgtccccgttgtaccgacggtcctcgtgtacttacctacgtttcgaggtaacggccgttaggatcgaacgttgggtcccgacgacggacctaccggaaggggtaacggggtccgtagggtacggttcggggttacgggtacccggttaaacgttaaaaacccgtaaaaccgttggtaaacggttgggttaaccgggaaaccgtaaacgtaaccggtaaaccttaacggtaccgttaccggaaccgtaaaccccgggttaaggaaaaccggggtaccgtaaagggttaaccgttaccgtaaacccgtttaacgtaccccgttttaagggaaaactacgggttaacttaggttaaaaaccgttaacgaaaaaaccggtctaccgttacgttacgttacgttaccgagtaacgttaaacgagtaaccctaacgggtcctaaagggacccggtaaaccgtacgggaaacccttacggaacccgttccgttaaggtttaaacctacccggttaacgtacccctaaccgtacccgttaacccgaaaggttaaccggaccccgttaataaaaccccttacggttaaacccgtaacccgtttaacggggtaacttccccgggtaacccttaaccggggg

SEQ ID NO: 199401 - DNA, 468 bp, Homo sapiens
  misc_feature: GYAE6OF02GS6X0.18.59.F04.1.454.CMB.1.raw
  modified_base (454)..(468): a, c, t, g, unknown or other
  misc_feature (454)..(468): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcacgcccaaggccaaccccatcgtcacctctcgttccccgccctcctccatacctcgtactgacgcgggctggacagggcacgatagnnnnnnnnnnnnnnn

SEQ ID NO: 199402 - DNA, 713 bp, Homo sapiens
  misc_feature: GYAE6OF02FFZHR.18.59.F04.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcaccaggcaaacgccccaaatcatgtatttangatgtcactaatccgcctcgtagggtttctaatcgtcttctctacggtcctacctaaagttcctaggtaccaaaccgtaccgggccccttacccgtacgtaaccccgtaattcccgtacggttacggggaccccttaccggaacgggtccgttacgggaacggggaccggaagggttaccttaacgggtaactttttaccgttaacgtcgtaccgtaacggtccgttaactaagtttaaccgaacctaaacggtacccaaccggtaagtacccgtaacgttccttaaccgtttacgttacggttacccgtttacggggaaaccgtttccggggaaaccctttaacgggtacccttacccggttaccgttaacgggtacccaccggtacccggaaccggtaaccccc

SEQ ID NO: 199403 - DNA, 821 bp, Homo sapiens
  misc_feature: GYAE6OF02JAAYA.18.59.F04.1.454.CMB.1.raw
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
  modified_base (547)..(547): a, c, t, g, unknown or other
  misc_feature (547)..(547): n is a, c, g, or t
  modified_base (646)..(646): a, c, t, g, unknown or other
  misc_feature (646)..(646): n is a, c, g, or t
tcagtacgagtatgcacgaccggtgctcgatttagtacacacacttagggattgggggggggtctcaggaggcagcgctctcgggacgtctccaccatggcctggctctgctattcctccaccctcctcactcagggcacgacgggtcctgggcccagtctcgccctgactcagcctgcctacgtgtcgttgggtcctccgtggactggtcgaatcaaccngttccttccgacgtccacgtcggaaaccgngcgtaggttcgacggttttggggttagttaaacttacgtattcggttaccttccgttagtaacccgtaacgaccgaccacccgaagggacccaaaaccggtacccccctaaaagtaccagtttcgtaattttacgttagtacgttactaccgtaacttacggttaccggtccccgtttagggttacggttttaacgtaccgttcgttacctttcgtcgtacgttcctaacgtacggttggacggtaaccaccgtaccgtccctccgttacaccgtactccgttacggtccggtacnccggtacggtagacgggtaggaccggtacggtactacggtttaattaacttcgacggtaccttcccgtacgtttaatacgtttaaccgaacggtaaccncgaaaccggtcgtaaaccgtcgttaaccgttacggttaaccggtttaccgacgggttaaccggtacccggtaaaccggtccgggtaaaccctttaccgggttaccggtttaacccggtacccggaacccggtaaccccggtaaccccgttaccccggtaacccttccgttacccg

SEQ ID NO: 199404 - DNA, 737 bp, Homo sapiens
  misc_feature: GYAE6OF02FZFVO.18.59.F04.1.454.CMB.1.raw
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaacagcacccgaggacaaacgacccccaaactcatgtatttatagattgtctaactaacgtccggtcccttacgtacggggttttcctaaagtccgtctttacgtcgtcgggtaccttaccgaagttccgtacggaccaaccgaaccggtcccttccccgtagaaccccacttcctacggtcgggtaccctccggaacgggtccttagggaacggtaccggtacgggtctacgggttatttaacgttacttggactacggtcttacgtaacttaacgtaacgaacgtacccgaacctacggtacctaacccgtttaccgtaccgtttaacttcgggttacccgtttaacgggaacccgttacggggaaacccgttaaccgggttacccggttaacccgttacccgggtttaacggtacccgtaacccggaaccccggtaaccccgggtaccccctaaccccgttaacccgg

SEQ ID NO: 199405 - DNA, 702 bp, Homo sapiens
  misc_feature: GYAE6OF02H1EHT.18.59.F04.1.454.CMB.1.raw
  modified_base (140)..(140): a, c, t, g, unknown or other
  misc_feature (140)..(140): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
  modified_base (291)..(291): a, c, t, g, unknown or other
  misc_feature (291)..(291): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacngggtcctgggcccagtctgccctgactcagcctgcctcgtgtctgggtctacctggacagtcgatcaccatcctcctgctacgnggaaccaggcaaggtcgtacgtttgggtagttaanaactatcgttacctccgtacggtaaccaacgngaccacaacgacggaacctaaaaccgaccccctaaataccaagttacggtaattttaagtgtaagttcgtacctaacttaacggtccgtacccgttacggtaacggggttttacctaaacggtcctacgtttccgtcgtcggtcctacgtaacgtcgtcggactaaccgaccggtccctactacgacctactccgtcgtacgggtcctacgacggtcgtacgggtaacgcggagtacgtagtaacgtttactacgttacgacgctaactcaacttaacgacgtaaccgaccgtaacccgtatacctaacgtccttaagttaccttaggtttccgtaacggaaacgttccgggaactaacggttccaacccgttacgacgtaccgtaaccgaccgaccggtaccctaacccg

SEQ ID NO: 199406 - DNA, 614 bp, Homo sapiens
  misc_feature: GYAE6OF02FI4ZV.18.59.F04.1.454.CMB.1.raw
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtagttataactatgtctccgtaggtaccaacacgccacccaggacaaacgcccccaaactcatgtattangatgtactaactactccgtcctgtacgggtttcaagtcgtcttctcgtgctacagtcgtgacaacgacgtcctcctcgacctactctacgtcgggcctccgacggcgtaggacgggacgtacggctagtatttactacgttcgactacgtctacgtaattaacgtaacaacgaccaaccgtaacgcctaacgttcttacgttacgttcgttccggttaacggaacgtacgggtaacctacggttacccgtaccggtaccgttacggccgtaacccgaccgtaacccgacccctaccgtaccg

SEQ ID NO: 199407 - DNA, 786 bp, Homo sapiens
  misc_feature: GYAE6OF02HGFC1.18.59.F04.1.454.CMB.1.raw
  modified_base (257)..(257): a, c, t, g, unknown or other
  misc_feature (257)..(257): n is a, c, g, or t
  modified_base (319)..(319): a, c, t, g, unknown or other
  misc_feature (319)..(319): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcgagtgtacggttggtagttataactntgttctcctaggtaccaacacgacacccgaggaccaaacgacccccaaactcatgtatttanagtatacgtacaactaacgtcccggacccttacgtagggtttacctaacgttccgtactttcctccgttcggtaccttaccgtaacggttcgtacggaccaaaccgtcccgggtaccccttccccgtacggtaaccctcgtttacccgttccggttacggggtccccttacccggacgggtaccgttacgggaaaccggggtacggtacgggtaccgttagggttaaacttttaacgttaccgttacggaccgtaacgtaccttacggtaaacttacgttaaacccgaaccggacctaaccgtaaccgtccttaacgttacccgtttacttacggttaccggttaccgtttaccggggtaacccgtaacggggtaacccgtaacgggttaaccccgtcccggtttaaccggtacggttaacccgtacccgggaacccgttaacccggaaccccgtaaccccgtaccg

SEQ ID NO: 199408 - DNA, 389 bp, Homo sapiens
  misc_feature: GYAE6OF02FGE0J.18.59.F04.1.454.CMB.1.raw
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (357)..(357): a, c, t, g, unknown or other
  misc_feature (357)..(357): n is a, c, g, or t
  modified_base (359)..(389): a, c, t, g, unknown or other
  misc_feature (359)..(389): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctcgtgtctcgggacccccggnagngggtcaccatctcttgttctggagcagctaccaacatcggaatcagccccaaggcctcgcccccctggtccacgttcctcgtcccctacccctccctcacgtaccttccggtactcggaggtccgggactcgggaccaagggccgacaagtagctncnnnnnnnnnnnnnnnnnnnnnnnnnnnnnnn

SEQ ID NO: 199409 - DNA, 966 bp, Homo sapiens
  misc_feature: GYAE6OF02I9MTS.18.59.F04.1.454.CMB.1.raw
  modified_base (728)..(728): a, c, t, g, unknown or other
  misc_feature (728)..(728): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggatttcctgctgctatttaaaggtgtccagtgtgaggtgcagcgtggtcggagtcgtggggacggtcgttagggtaaacgggtcccgggggggttacccttaacgggaccgttacccccgttaggtaaccgtacggtacccgttccggtacgggtaactttcccgtaaccgttttacgtaaacggttaaaccgggccccgttaggggtaaacgttacgggtaaaaccggtttcgggggttaaccccccgacccggttaaaccggggccccgttaaccccgggaaggggggtaaaaccgggggttcccggttagggggtaaccgggtttgggggggtttaccggtaaaccccggggtttaaaaacgtttaaaaaaaaccccggtaaaaacggtttacgggtaacggtttaaccggggttaaacggggaaaccctaaaacggtacgggtaaacccgttaaacggccgttaacggtacccggtaaccccgggtaaaggtaaaacggccaaaggtaccgttacaacccgtagtacctaacggtaaacgtaggtaactagtaacttaaagaaaacnccgtaacgtacgtacgtaagtcctaagaactaaacgttacgaaacgttacgaacccgttaaggaaccgaaaccggtacgaacccgtaacgttaccgaccgttaaagtaaccgttaacgtacctaacccggtaactaacccgtcccgtaaaacggttacggaacccgttcgtaaaaacccgtttcccgaaacgtttaacccgtaacggttaaaccgtaccggttaccctaaccgggggg

SEQ ID NO: 199410 - DNA, 632 bp, Homo sapiens
  misc_feature: GYAE6OF02I05V8.18.59.F04.1.454.CMB.1.raw
  modified_base (233)..(233): a, c, t, g, unknown or other
  misc_feature (233)..(233): n is a, c, g, or t
  modified_base (404)..(404): a, c, t, g, unknown or other
  misc_feature (404)..(404): n is a, c, g, or t
  modified_base (579)..(579): a, c, t, g, unknown or other
  misc_feature (579)..(579): n is a, c, g, or t
  modified_base (628)..(628): a, c, t, g, unknown or other
  misc_feature (628)..(628): n is a, c, g, or t
  modified_base (631)..(631): a, c, t, g, unknown or other
  misc_feature (631)..(631): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcaccaggccaaacgcccccaaactcatgtatttangatgtaccaactaacgtccggtcccctcgtacggggtttctaactccgtctttcctcgttggcctaccgtaagttccgtcggaccaaccgaccgtccctccctacgacctactacgtccgtcgggacctccgaggtcgtacggaggacggaggtctagtatttactacgtnactacgactactaataactacgaacgaccaccgagcctactccgtatacgttctacgttacggacgtacggaaccgacgtccgaccgtaccggtagaccgacgaacccgaccgaccctaacccacgtccactaccttccgtcccgttacccctaccgtccctaccacgttacccncgttacgtcggacgtccgggtcacggtacgaggtccaagatggacatcnacng

SEQ ID NO: 199411 - DNA, 659 bp, Homo sapiens
  misc_feature: GYAE6OF02HX9HM.18.59.F04.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (268)..(269): a, c, t, g, unknown or other
  misc_feature (268)..(269): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtgttataactntgtctctagacacnncaccgagacaacgaccccaaactcatcgtatttagngtatcgtactactaacgtccgcccttacgtagggttactaactccgtctttcgtcgtcggtacctaccgtaagtcgtacggacctaaaccgtccggtccctcccgttacgacctaactccgtcggtccgggtcctacccgagggtcgtacggacggtacggacggtacgttagtaactttacgttacgacgcgtaacgtcgtactaataacgtaaccgacgacccaaccacgtccgttaacttcctaacgttcgttacgtttaccgtaaccggtaaccggtacgggtaaccgtaacgggtccctaacccggtcgtacggtaccgtaccgaacccgaccgacccctacccgtacg

SEQ ID NO: 199412 - DNA, 639 bp, Homo sapiens
  misc_feature: GYAE6OF02G8JIQ.18.59.F04.1.454.CMB.1.raw
  modified_base (416)..(416): a, c, t, g, unknown or other
  misc_feature (416)..(416): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatccaccatctcctgaccactggaaacccagtccaggtcggtaccggttttggtaggtttaataacctattgttccttccgtaggtaccaacagccacccaggccaaacgccccccaaaactcgatcgtatttatgatgtctactatccggcctcgtagggttctaatcgtcttctctggctaccgagtcgtacgacaacgtccgcctcccngacctactctacgtggtcctacgcggtcgtggacggacggtaggtcctagtatttacttacgtcgacgtacgctagtaactaacgtaaccgaacgtaccaacccgatacccgtacttccgttaacttacgttacgttaccgttcggtaacgtcgggaacccttaagggtcccaccggttacccttacggtaccaccgaccgaacccggaccctaacccgtccg

SEQ ID NO: 199413 - DNA, 655 bp, Homo sapiens
  misc_feature: GYAE6OF02HQK93.18.59.F04.1.454.CMB.1.raw
  modified_base (311)..(311): a, c, t, g, unknown or other
  misc_feature (311)..(311): n is a, c, g, or t
  modified_base (430)..(430): a, c, t, g, unknown or other
  misc_feature (430)..(430): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggatttctgctgcttatttaaaggtgtccagtgtgaggtgcagcgtggtggagtcgtgggggagcgttggtaaaggccggggggtcctaggacctcccctgtacagcctcgtggtacttctactttcagtaaggtcctggatgaacgtgggtccncgaggctaccgaggggacgggctgggagtggtggaccgttaagttaaaaccgaaagtgaagtgggtacggaacaacgacgaactacgcgtcgaccgaccgtagaagcagacttcgactntactagaagagtatgtaacttaacgaaaagcaacgtctagtaacgtctacgactaaagtacgtaaacgacgtaccgtaaggaaccgtaaaccggacgaaaccgacgtacgtaaccgtagttaaccgttacgtaacgtaccaaccgttaccgtaacccgtaaggaaaccgtccgtaacctaaccttacgtaaccgtaccttaacggtactacgggtaccctacggg

SEQ ID NO: 199414 - DNA, 758 bp, Homo sapiens
  misc_feature: GYAE6OF02GMED5.18.59.F04.1.454.CMB.1.raw
  modified_base (235)..(235): a, c, t, g, unknown or other
  misc_feature (235)..(235): n is a, c, g, or t
  modified_base (278)..(278): a, c, t, g, unknown or other
  misc_feature (278)..(278): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcgtggacagtcgatcaccatcctcctgcacgtacggaaccngctagtgtacgttggtgttataactgtgtctcgtggtaccaanacgccaccgaggaccaaaccggacccccctaaaactcaacgtagtactttaatgtaacttcggtacctaacgttaacgtcccggtaccccgttaggttacggggttttacctaacgttccggtcctttcgtacgtcggtccttacccgtaaggttccggtacggaccaaccgtacccggtcccttcccgtaaccgtacccgtacttccgtcccggttacggggacccttaccggaaccgggttccgtaacgggaaccgggtaaccgggggtacgtacccggttagttaaccgttttaaaccgttaccgggtaccgtaccggttaacgtaccctttaacgtaaacgtaacgttaaaccgaacacccgtaaacaccggtacccttaccgtacttacgttaacgtcgtttacccgtacggtaacggtcgggaactaccggtcgtacccgtcgtacgtacgccgtacccaacgccctacgtacg

SEQ ID NO: 199415 - DNA, 667 bp, Homo sapiens
  misc_feature: GYAE6OF02HCW2D.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttaataactatgtctcctggtaaccaacagcacccaggacaaaacgccccccaaaactcaatcgtaatttatgtatgtacaactaatccggaccctgtacggggtttctaagtcgcttctctggctaccaatcgtgactaacgaccggtccctcccgtagaaccctatccgtcgtcgggtcctaccgacgggtcgttagggaacggaaccgggtacggtccgtaggtaaacttttaagttttaccgtcgaccgttaacggaccttacaattaacttaaccgaacggaccaaccgtaggacctaaccgttactacgttacttacgttacgtttaccggtaaacggtcgggtaaccgtaaacggtacctaacccgttaccgttacggtacctaaccggacccgaacggtaccccaaccctaccg

SEQ ID NO: 199416 - DNA, 659 bp, Homo sapiens
  misc_feature: GYAE6OF02ILVZI.18.59.F04.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctggtctctggacngtcgatcacntctctgcactgaaccngcagtgacgttggtagtataactatgtctctgtaccaacacgcacccagacaaacgacccccaaacgtcatcgtatttatgattcgtactactaactcgtccctacgtacgggtttacaacgtcgtcttcgtcgtacggtacctccgtaacgtcgtacgaccgaactaccggcctcccgtaccaccgtactccgtcggtcggtacctaccgtacggcgtagggacgacgggtacgtcgtagttagtttacgtttacgtcggaccgtacgtctacgtaacttaacgtaaacgaaccgtaccaaccgacgtacccttctaaccgttactaacgttcgtaccgttaccggacgtaacgggtacctaaccggtacctacccggttaaccgttacggaccggtaccgaaccccggtaaccgtacccccgaacccgtacccg

SEQ ID NO: 199417 - DNA, 716 bp, Homo sapiens
  misc_feature: GYAE6OF02F79UB.18.59.F04.1.454.CMB.1.raw
  modified_base (220)..(220): a, c, t, g, unknown or other
  misc_feature (220)..(220): n is a, c, g, or t
  modified_base (706)..(706): a, c, t, g, unknown or other
  misc_feature (706)..(706): n is a, c, g, or t
tcagtacgagtatgcacgaccggtgctcgatttagtacacacacttagggattggggggggtctcaggaggcagcgctctcgggacgtctccaccatggcctgggctctgctattcctcacccgtcctcactcgagggcacgagggtcctcggggcccaggtctgccctgactcagcctgcctccgtgtcctgggttcctccgtgactgtcgatcaaccnttcctccgtgacacgtcggaacctggccaggttcgtacggttggtagttactaacgtgttgtctccgtaggtaccaagacgtccacccgaggtaccaaacccgtaccccaactactacgtaggttaacttttagtgtacggttacgtacgtaacgttacgcccggttacctacggttacgggttttacaagttccggtacttcgttcgtacgtcgtaccgtagttcgaacgtccaacgtccggtacccttacccgtcgaaccctgttccgtacggtaccgggtcttaacgcggtacgttacggaacgggttcggagttcgagttactttacgtctaggcctacgtacttcgtactactagtaccgagacgtcacgtacacccgttaagtaccgttacggtcgtaccgtacggtaaccgtaccgtaaccgtaccgttaaccgtaacgttacccgacccggtacccgtaaccgtccccgtacccggtnttaacccggg

SEQ ID NO: 199418 - DNA, 649 bp, Homo sapiens
  misc_feature: GYAE6OF02G2YHY.18.59.F04.1.454.CMB.1.raw
  modified_base (184)..(184): a, c, t, g, unknown or other
  misc_feature (184)..(184): n is a, c, g, or t
  modified_base (221)..(221): a, c, t, g, unknown or other
  misc_feature (221)..(221): n is a, c, g, or t
  modified_base (485)..(485): a, c, t, g, unknown or other
  misc_feature (485)..(485): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctatttttaaaaggtntccagtgtgaggtgcagctgggtggagtcgtgggggnggcttgggtaaacggccgggggggtcccttagacctcccctgtacagcctcgtggattcactttcagtaacggcctggatgaactgggtccgcgaggctccgaggggaagggctggaggtgggttggccgtaataaaaccaaacgtgagtgggtacgggacaacgagactacgcgtgccgacccggtagaaacggcaagtacttaccaccgtatcctacgaagtagtatagtacttaacgaaaaacgcacgctagtactcgtanacaatacgaacacgccgtacggaacgaaccgaagggaccaacgacggtaccggttagttaactttaccgtacgtaacccgacgtacctacccctaggaaaccgtcctaacaaccttacctaccttaacgtacggttactacggaccttcggtacgggaacccgg

SEQ ID NO: 199419 - DNA, 716 bp, Homo sapiens
  misc_feature: GYAE6OF02JC6N2.18.59.F04.1.454.CMB.1.raw
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctcgccctgactcagcctgccctccgtgtctgggtcctcctggacagtcgatccaccatctcctgccacgtcgaaccaggccagtcgacgttggtagttaatactattgtccttcctaggtaccaacgacgaccaccgacggaccaaacggaccccccaaactcgaatcgtaatttatgtacgtgtccaacgttacgtccggccctacggttacgggtttcctaagtcgtacctttctcgtcgtcctacgtaacgtcgtcggtacaccgtaccgcccttaccgcgtaccctctcctaccgtcggtccctacgacggtctggaggacggaggcgtacgttaagttacttacgtcgaccgtgtaccgtactaacgtatttaaccgacgtaccgtaaggccaacgtaccgtaaccgttaccgtaacgttaccggtttaccgaaaccggttacccgggtaaaccggtaaccggttacccggtaacccggttacccttacgggtacccgtaacccggtaaccccggtaaacccggaccccctaacccccgtaacgttaccccgg

SEQ ID NO: 199420 - DNA, 824 bp, Homo sapiens
  misc_feature: GYAE6OF02FI0IR.18.59.F04.1.454.CMB.1.raw
  modified_base (237)..(237): a, c, t, g, unknown or other
  misc_feature (237)..(237): n is a, c, g, or t
  modified_base (334)..(334): a, c, t, g, unknown or other
  misc_feature (334)..(334): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcaggcacagggtcctgggcccagtctgccctgactcagcctgcctccgtgtcctgggtacctccgtggaccagtccgatcaccatcctcctgacactggaacccnggcaggtcgtaccggttggtcggttaataactattgtcctcctggttaccaacacgccacccgaggaccaaacgcccccaaactcactgtattagtnatctcaacttaacgtccggccctacgacggggttttctaacgtcgtcctttacgtctaccggtctaccgtaacgtcgtacggtaccgtaaaccgaccggtccctacccgtacgaccctagttacccgtcgtacgggtaccccttccggaacgggtcccgtagggaacgggtacccggtaacgggtcctaaggttaaccgttttaaccttacccggttaccgaaccgtaaccgggtttaacctttaaaacgttaaacgtaaacccggtaaacggaacccccttaacccgtaaaccgtaacccggtttaaccttaaccttaccggttttaaactccggtttaaccggttttacccgggaacgttaacccgggggtaaaccccgtaaacggttcccccggaaacccggttacccggtttaacgggttacccgaaccccggttaccccgaaacccgggtaaccccccctaaaccccgtcccgtttaaacccggg

SEQ ID NO: 199421 - DNA, 891 bp, Homo sapiens
  misc_feature: GYAE6OF02GFDMX.18.59.F04.1.454.CMB.1.raw
tcagtacgagtatgcacgaccggtgctcgatttagtacacacacttagggattggggagctctgggagaggagccccagcccttgggattcccaagtgttttcattcagtgatcaggactgaacacagaggactcaccatggagtttgggctgagctggtattttccttgctgtcttaattttaaaggtgtcctagtgtggaggtgcaggctgggtggagtcggtgggggaggtcgtttagggtaaacggggtcccgggggggttacccttaacggaccgttcccccgttggtaccacgtcctcgtggtacttctaactttcgaaggtaacggtccgttacggattacggaaacgttcggggtaccccgtccgaacgggcccttaccgggaagggggaacggggggtccgttggggtaacgggttggggggtttccgggtaacccgtttaaaacgtttaaaaaaccccgaaaacgttggtaggttacggggtaagggaaccgaaacgtaaggtaaccgtaaccgtccgttacgggaccccgtaacccgggttaaggaaaacgggtacgaaacggttacttaccccgtaaccgtacgtttacccttaacgaaaacggtaacgttaaagtaggtaaactttaaaaccgaaaaaacggtcccaaaccgggtaactacgttaacttacgtaacgtaactaaacggtacgaaactaccggtacgtaacggaaccgggaaacccgaacgggaaaccacggtaacgtacccggtttattaacgtacccgttagttaacccaacgttacccgtaacccgaaggtaacccaccgttaaccctaaccgtttaaccgttaccgtaaccgttacgggtttaccgaccggttaccctaccgggg

SEQ ID NO: 199422 - DNA, 804 bp, Homo sapiens
  misc_feature: GYAE6OF02IZDKF.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctcgccctgactcagcctgccttccgtgtctgggtctcctggactagtcgatccacctactcctcctgccacgtcggaaccagctaggtgtacggtttgggttaggttaactaacttattgtccttccgttaggttaaaccccaaacacgtaccaacccccgaaggacccgaaaacgaccccccctaaaacttccaacttcgtaattttacgtgtaactgtacctaacttaacgtccggtccctacggtagggttttacctaagttccgtacgtttaccttcgttcggacccttacctaacggtttcgtacggtacctaaccggtacccggtaccccttccccgtacgtacccctacttccgtccggttccgggtcccttaccgacgggtacgtacggtaacgggaccggtaacgggttacgttaggttaacttttaactttacggtacgtaccggtacgtcctaacgttaaacgttaactaaccgaaacgtccctaacgaccgtcttaaccctttacctaaccgttacgttacgttaccgtttacgggacccgtttaaacgggacccgtaacggttaaccctacccggtttaccggtacggtacccgtaaccggtacccccgaacgggtaccccctaaccctacccg

SEQ ID NO: 199423 - DNA, 861 bp, Homo sapiens
  misc_feature: GYAE6OF02HFY6C.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcactggaaccagcagtcgtacggttggtaggttaactaacttgtcgttccgttccgttacggtaacccaactacgaccaaccccgaggaccaaaccgaccccctaaactccaattacgtatttaactgtagttcgtactaacggttaacgtccgggcccttacggttacggggttttacctaacgttccgttccgtttccttcgttcggtacctaccgtaacgttcgtacggtaccgtaaacccggtaccccggtccccttaccccgtacgtaaaccccgttacgtttacccggtttccgggttacccgggtaccccgttaccccgggtaaccgggttacccgttaaccggggaaacgggggtaaacccgggttacggggttaacccgttttaagggtttaaaccttttaacgggttttaaccgtacccgtaaaccggtcgtaccggttaaccttaaacggttaaacctaaacccggtaacggtaacccgtaacggaccgtaaccgtacttaacccggtaccttaaacggtttaccggtacccggtaacggtaccggggtaaacccgtaccgggttacccgtaacccgttacggtacgtaccgaacccgtcccgaaccggtaccccacccgtacttacccgg

SEQ ID NO: 199424 - DNA, 886 bp, Homo sapiens
  misc_feature: GYAE6OF02HRXCS.18.59.F04.1.454.CMB.1.raw
tcagtacgagtatgcacgaccggtgctcgatttagtacacacacttagggattggggagctctgggagaggagccccagccttgggacttcccaagtgttttcattcagtgatcaggactgaacacagaggactcaccatggagtttaggctgagtcttgggttttcctcgttgcttatttagaggtgtccagtgtgacgtgcagcgtggtgagtcgtgggggagtcgttcggtccgacgtccggtcggggggtccctggacgacttccgtcctaggtcggccgacggtcccctgacctattacgtatttaccttttaaagttagtttagtttaggatcggacctacggttcggggtcccgaccggagggtacccgggtccggggggaacgggggcccgggtagggtcgggggacgtaccgtaaacaagttaacgtacgaacaaggtataaggggtaactaagggaaacgtaaagtaaaccgtaaggttcggtaacggtaccttggtacggtaagggaaccggggtacctacgtttacccgaaaccctacgttcccgtaccgaaacggtaaaccgaaccgaaacccgtaaaaccgttaaaaccgttaaacccgttttaaaccgtttaacgtttaaccgttaaccgttaaacgtaaaacctaaaagggtaaccggtaaaaccgtacccggttaccgaaaccgttaacgggaaccggtaacccggggaaaaccgggtaacccggaaccggttacggtttacggttaacggtttacgttaccggttagggttaccggtaaacgggtaacggttaacggaccgggttagggttaacccggggtacggttaccgggggtaaactttacggggaaccggggttaacccgggg

SEQ ID NO: 199425 - DNA, 752 bp, Homo sapiens
  misc_feature: GYAE6OF02GOLWV.18.59.F04.1.454.CMB.1.raw
  modified_base (234)..(234): a, c, t, g, unknown or other
  misc_feature (234)..(234): n is a, c, g, or t
tcagtacgagtatgcacgaccggtgctcgatttagtacacacacttagggattgggggctggggtctcaggaggcagcgctctcgggacgtctccaccatggcctgggctctgctacttcctcaccctcctcactcgagggcacagggtcctgggcccagtctgccctgactcaacctgcctcgtgtctgggtctccgtggacagtcatcacctatctcctgcactcggaaccngacgaggtgtacggttggtaggttaactaacttagttcgttccttccgttacggtaacccaaacgtacgaccaaccccgaggaacccaaaccggaccccctaaactcgaactgtatttaagtgtattgtaccacgttaacgtcccggtacccgttaggttacgggtttacttaacgttccgttacgtttcgttcgtcggtaccttaccgtaacgttcgtacggaccgtaaccgtcccggtcccttacccgtacgtaaccctacttccgtaccggtcggtacccgtaccggacggttccggaggtaacgggacggtaacgggttaccgttggttaacgtttacgttacgcgtaccgaattccctaataacgttaactacgaacgtaccgtacgacggtaacccttcgttaccttacttcgttgttacccggtacggtaacggtacggtacccggttacggtacccgtaccggtttaccgacggacccgtaccgacccggtaacccgtacccgtaacccg

SEQ ID NO: 199426 - DNA, 592 bp, Homo sapiens
  misc_feature: GYAE6OF02FVS03.18.59.F04.1.454.CMB.1.raw
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (325)..(325): a, c, t, g, unknown or other
  misc_feature (325)..(325): n is a, c, g, or t
  modified_base (393)..(393): a, c, t, g, unknown or other
  misc_feature (393)..(393): n is a, c, g, or t
  modified_base (585)..(585): a, c, t, g, unknown or other
  misc_feature (585)..(585): n is a, c, g, or t
  modified_base (590)..(590): a, c, t, g, unknown or other
  misc_feature (590)..(590): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgcccccaaactcatgtattatgatgtcactaatccggccctgtaggggtttctaagtcgtcttctctggtctcaagtctgcaacncgcctcccngaccntctcgnggctaccgnggtctgacggacgaggctagtacttattcgtgacagctctaatactacgaagccaccagccacttctntatcgtacgttacggaccgtagggacctaacggtcctacccggtaccgtaggttccgacgtacccgaacgacccctaacccgtctacgtactaccttcctaccgttccccacccttccctaactacccttaccttccgtacgtaggcccgggtcggtcggtacggaccgtagggtccgactacgtcgactgntacgncg

SEQ ID NO: 199427 - DNA, 842 bp, Homo sapiens
  misc_feature: GYAE6OF02G5KHS.18.59.F04.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
tcagtacgagtatgcacgaccggtgctcgatttagtacacacacttagggattggggtctgggagaggagccccagccttgggattcccaagtgtttcattcagtgatcaggactgaacacaggaggactcaccatggagtttgggctgagctggattttcctgctgctattttaaaggtntccagtgtgaggtgnagctggtggagtcggtgggggaggtcttagggtaaacggcccgggggggttacccttaggacctccccgtagtacgacgtcctcgtggtacttctaccttttcgaagttaacggcctaggtaactcggaaccgttcgggggtaccccgtccgaacgggtcccttaccggaacgggggtaacgggggtcgttaggggtaggttacgggggttcggaacccggttaaaacgtttaaaaaaccccgaaaacgttcggtaagttacggggtagggggaaaccctaaaacggaacggtaaccgttaaccggccttacggaccgtaaccccggtttaaggaaaaacgggtctaacggtaacgtttacccgaaacctaacgtaccttaacggaaacgtagtaacgtaacgtaaacgtttaaaccaaaaacggtcctaaaccggtacgttaacgtacgttaccgtacggtaaactaaaaacggttccgaaaacgtccgtaacccggtaacggaaacccggtaaaccgggaacggtaaccgaacgtaccggtacgttacgttacgtaaccgtacgtaacctacgtaccctaccgtaagaccgactactaactacgtaacctagtacgtcgtacggtaccgtcggtacggtaaccg

SEQ ID NO: 199428 - DNA, 635 bp, Homo sapiens
  misc_feature: GYAE6OF02JR2E1.18.59.F04.1.454.CMB.1.raw
  modified_base (231)..(231): a, c, t, g, unknown or other
  misc_feature (231)..(231): n is a, c, g, or t
  modified_base (310)..(310): a, c, t, g, unknown or other
  misc_feature (310)..(310): n is a, c, g, or t
  modified_base (406)..(406): a, c, t, g, unknown or other
  misc_feature (406)..(406): n is a, c, g, or t
  modified_base (431)..(431): a, c, t, g, unknown or other
  misc_feature (431)..(431): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctctcactcagggcacagggtcctgggcccagtctgccctgactcagcctgcctccgtgtcgtgggtctcctggacacgtcgatcaccatcctcctgcactggaaccngcagtgacgttggtgttataactatgtctcctggtacaactgctaccaggacaaacgccccaaactcacgtgactttangtatgtactaactaactccggcctacgtagggtttactaactcgtctcgtactcgtactacgacgtctcggtacacgacgccctacctacgacctntcctcgtcggtaccgtccgaagtcnggtacggactacgggctaggttacttaacgttcgtacgacgtagtacctagttactaagtaccaaacgtccaaaccgtacgtacccgtactacgttacctacgttcggttcctaacggggtaacgtacccgggtaacgttaaccggtacccgtaccggttacctacggtccaccggacccgtaacggtacccaacccggttacg

SEQ ID NO: 199429 - DNA, 736 bp, Homo sapiens
  misc_feature: GYAE6OF02G2G65.18.59.F04.1.454.CMB.1.raw
  modified_base (221)..(221): a, c, t, g, unknown or other
  misc_feature (221)..(221): n is a, c, g, or t
  modified_base (332)..(332): a, c, t, g, unknown or other
  misc_feature (332)..(332): n is a, c, g, or t
  modified_base (536)..(536): a, c, t, g, unknown or other
  misc_feature (536)..(536): n is a, c, g, or t
  modified_base (566)..(566): a, c, t, g, unknown or other
  misc_feature (566)..(566): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctggggcccaggtctcgccctgactcacgcctgcctccgtgtctgggtctccgtggacaggtcgatcacactcnctgcactagaacagcagtcggtacgttggtagttaataactgtcgtctaccgtacggtaccaacacgaccaccagaaccgaaaccgacccccaataccatagtaactttanacgtatacgtactaactaacgtccggtcccttaggttacgggtttactaacgtcttctttaccgtcgtacggtacctaccgtaacgtcgtacggtaaccaaccgtaccggtcccctaaccgtaccacctacttccgttccggtcgggaccgttacggacggtcgtacggaaggtaccggaggtcgtagtaatttacgtacgtanacgtcgtactacgtaacttcgaacgaaacnccgtaaaccgactaccgtaaccttacgtacgtttacggttaccttaaccggttaccggtaaccgggtacggtaaccgttaaacgggttacccccgtaccggttaaccgttaacccgggtacctaaacccgggtaccccgaaaacccggtaccccctaaccgttaacccgg

SEQ ID NO: 199430 - DNA, 682 bp, Homo sapiens
  misc_feature: GYAE6OF02GFGZP.18.59.F04.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcacatctcctgcactggaaccngcagtgacgttggtagttatactntgtctccgtggtaccacagccaccgacgacaacgacccccaaactcatagtatttatagtactcgtactaacgtaacgtcccggtacccgttacggttacggggttttacctaacgttcgtcctttaccgtcgtcggtccttaccgtaacgttccgtacggacctaaccgtacccggtccccttcccgtacgtaccctacgtccgttacggtacgggtcccttacggacgggtcgtaacgggacgggtacgacgggtctagttaatttacgttactcgtacacgtctacacttactaacgacgtacgacgacgtacacgtactaacgtacgttacgtacggaacggtaccggaaaccgtaccggtacccgtaaccgttccgtaacggaccgtaccgacccgaacccggtaccccgaacccgtacgttaccg

SEQ ID NO: 199431 - DNA, 604 bp, Homo sapiens
  misc_feature: GYAE6OF02FM7JD.18.59.F04.1.454.CMB.1.raw
  modified_base (171)..(171): a, c, t, g, unknown or other
  misc_feature (171)..(171): n is a, c, g, or t
  modified_base (183)..(183): a, c, t, g, unknown or other
  misc_feature (183)..(183): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (571)..(571): a, c, t, g, unknown or other
  misc_feature (571)..(571): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcancctgcctccggntcgtgggtctctggacagtcgatcacgatctcctgcatggaaccagtcatgacgttggtggttaataactatgtactctggtaaccaactaggccacccaggtaaccaaacgacccccctaaactctaagtacgtaattactgatagctactaactacgccctagtacgggttactaacgtcacttctcgtgctaccaagtctagacacgaccggacctccgacgtaccactcgtacgtaggtctaccgagcgtagaaggacgggngcgtactagttacgtntacgcgtanctagtactataacaacgtcaccgaactacactcgttactattcgttacgtaccggtacgtaccgggaaccgtagtaccgtacctaccggggggtacnccgaacgaccgtaaccggtacccaacccgtacc

SEQ ID NO: 199432 - DNA, 552 bp, Homo sapiens
  misc_feature: GYAE6OF02GE2SD.18.59.F04.1.454.CMB.1.raw
  modified_base (441)..(441): a, c, t, g, unknown or other
  misc_feature (441)..(441): n is a, c, g, or t
  modified_base (546)..(546): a, c, t, g, unknown or other
  misc_feature (546)..(546): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttaataactatgtctcctggtaccaacagcacccaggcaaacgcccccaaactcatgatttatgatgtcagtaatcggccctcgtaggggtttctaatcgtcttctcgtggctaccaagtctggccaacgacggccctccctgacctatctcgtgggcctccgaggctcgaggacgaggtctgtaatttattaacgngacagctacaatactacaagccaaccagctactctctattcgtcttacggaactcgggaaccaaggtccaccgttctaggtcacgacccgaacggccctaacccnttaccg

SEQ ID NO: 199433 - DNA, 617 bp, Homo sapiens
  misc_feature: GYAE6OF02GPAXT.18.59.F04.1.454.CMB.1.raw
  modified_base (373)..(373): a, c, t, g, unknown or other
  misc_feature (373)..(373): n is a, c, g, or t
  modified_base (607)..(607): a, c, t, g, unknown or other
  misc_feature (607)..(607): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaactcatgatttatgatgtcactaatccggccctcgaggggtttctaattcgctttctctggcctacaagtctggacaacacggccctccgtagacctatcctcgtcgggcctccgaggccgtaggacggacggaggtcgtagatttacttcgngcacgtctactataatacaagccaccagcctactctactatcgtacgttacggacgtcggacctaggtccacccgttacgtggttacccaacgtaccccgaacggaccccaaaccctacgttcgtaacccaccgtttccgttaccgttccccctacccttccctacccgtaactcccgtacgttacgtcggtacggccggtcgtcgggaacctacggccgtacgtactacgcancgngtacncg

SEQ ID NO: 199434 - DNA, 745 bp, Homo sapiens
  misc_feature: GYAE6OF02I6YT6.18.59.F04.1.454.CMB.1.raw
  modified_base (233)..(233): a, c, t, g, unknown or other
  misc_feature (233)..(233): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctctcactcaggcacgagggtcctgggccaggtctgcctgactcagcctgcctcgtgtctgggtctccgtggacagtcgatccactctctcctgactacgtacggaaccnggctagtgtacggttgggtagttaactaaactgtacgtcctccgtacggaacctaacgtacgactaaccccgaggtaaccaaacccgacccccctaaattccaattacgttactttataggtaacgttcgtactaaacctaacggtccgtacccgttacgggttacgggtttaactaacgttccggtcgttttcctaccgttacggtcctaacccggtacgtttacgaccggtacgaaccgtaccgtaccccttccgtacgtaaccctctttccgtcggtccggtacccgtacggaccgtacgaacgggacgggtacggacgggtctaacgttactttaacggctacggtcaacgtctaacgtattataacgacgtacacgcgtaactccgtactacttacgttccggttaccgtaggttaacggtacgggtaaccttaccgggtaaccgttccggaaccgtttccgggaaccgtacccggacccgaacccggtacccctaaccgtacccgg

SEQ ID NO: 199435 - DNA, 760 bp, Homo sapiens
  misc_feature: GYAE6OF02JS7A7.18.59.F04.1.454.CMB.1.raw
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcgtggacagtcatcacctatcctcctgactacgtacggaaaccngcaggtcgtacgtttggnggttaataactgtgtctccgtaggtacctaacgacgccacccgaggaccgaaaccgaccccctaaacgtcaacgttcgtaatttacgagtagtacgtactaacgtaacgtccggtaccttacggtacgggtttactacgtcgttcttctcgtcgcgtactaacgttctacggacctaacgtcccgtccctccgtacgtacctacgtccgtacgtcgtaccgtaccgacggtcgtaggacggtacggtacgtacgttacggtaatttaaccgtagtacggtaccgttaaacggtccttaacgttaaacgttaaacgtaaaccggttaccggaaaccctaccggtaaaccgtccgttacgtttaaccgtccgtttaacgttaaccggtttccggtaaccgggtaaaccggtttaccgggaacccgttacgggttacccccgttacgttacccggttacggtaacccgccggtaacccgtaacccggttaccccgaacccgttaccgg

SEQ ID NO: 199436 - DNA, 653 bp, Homo sapiens
  misc_feature: GYAE6OF02HYCHK.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctccgtgtcgtcgggtcctcccggacagtcgactcacctatcctcctgacctacgtggaaccagctaggtgtacggttggtagttaactaacttatagtctacctacggtaccaacagtaccaccgacggacaaaccgaccccaaactactatagtactttatagacttgtctaacgtaacgtccggtccctacggtacgggtttactaacgttcgtaccttctcgtcgacttaccgtacgtcgtacgactaaccgaccgtccctaccgtacggaaccctacgttaccgtccgtcgggtccgtaccgtaggtcggtggacgggacggcggtacttagttaactttacgttacgcgtacacggtacctataacgttaactaacacgaacctacgacgtactcctacttctacgttctacgtcggaacgtacggactacggtccacgtcgtcgactacgccgtacgacctaacccg

SEQ ID NO: 199437 - DNA, 736 bp, Homo sapiens
  misc_feature: GYAE6OF02HF58Y.18.59.F04.1.454.CMB.1.raw
  modified_base (199)..(199): a, c, t, g, unknown or other
  misc_feature (199)..(199): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacngtcgatcaccatcctcgtgcacgtggaaaccagcagtggtacgttgggtaggttaataactatgtctcctaggtaaccaacagccaaccgaggacaaaccgacccccaaactcaactcgtaagtttatacgtatcgtacaactaactccggtcctacgtacgggtttactaacgtcgtacttctacgtggtacctaccgtacgtcctacggacctaaacgaccgtccccgttcccgtacgaacctaccgtccgttaccggtcgggaccgttaccggacggtcggtacggtaacgggacggtaacggtcgttagttaaactttaacgtttaccgtacggaccacggttacctaccgtaaacttaacgttaaacccgaacgggtcccaaaccggtaccgtaacctaccgtttacccgtaacttacgttaccggttacccggttacggtaaccgttaacggggtaacccgtaacggtaccgttaaccggtaccgttaacggacccaccggacccgtaacccgaccccgtaacccctaccg

SEQ ID NO: 199438 - DNA, 658 bp, Homo sapiens
  misc_feature: GYAE6OF02F3I8G.18.59.F04.1.454.CMB.1.raw
  modified_base (109)..(109): a, c, t, g, unknown or other
  misc_feature (109)..(109): n is a, c, g, or t
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
  modified_base (309)..(309): a, c, t, g, unknown or other
  misc_feature (309)..(309): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (654)..(654): a, c, t, g, unknown or other
  misc_feature (654)..(654): n is a, c, g, or t
tcagtacgagtatgcacgaccggtgctcgatttagtacacacacttagggattgggggctttgtctgggtctcctggacagtcgatcaccatctcctgcactggaaccngcagtgacgttggtggttataactatgtctcctggtaccaacagcacccaggcaaagcccccaaatcatgatttangatgtcactaanccgcctcgagggtttcaatcgcttcgtcctggctccaagtctggaccaacacggtccctcctagacctatctcgtgggcctccgagtctgacggacgagctgattacttacnggcagctacatanacagcaccgntcactctgtatcgtacgtttcggaacgtgggaaccaacgtccgacccgtcgtacggtccacggcccctaaacgggccccaaaccccgtacgtcgttacccgtaacgttccgttacccggttaccctacccccgttaccttacccctaacggttaccttaccgggtaaccttcgggtaaccggggacccggggttaccgttacggggtaaccgtaaccggggtaccgtaccgttaaacgttacggcaacggttcacgacgtatcccgggtagcgtacgtctacgtccgtagaccgttctaccgcgtcgtcgtacgttaccganacgg

SEQ ID NO: 199439 - DNA, 690 bp, Homo sapiens
  misc_feature: GYAE6OF02JFWJ3.18.59.F04.1.454.CMB.1.raw
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
  modified_base (315)..(315): a, c, t, g, unknown or other
  misc_feature (315)..(315): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctcgtgtcgtggtctccgtggacngtcgatcaccatcgtcctgcacgtggaaccagcagtgtacgttggtagttataactatgtctcctgtaaccanagcaccaggacaacgccccaaatccagtagtatttacgngatcgtactagtaacgtccggaccttcggtagggtttactaacgttcgtccttcgtcgtcgtctaccgtaacgttcgtacgactaaccgaccgtccctccgtacgaccgtactcgtaccgtcgggtaccttacccggacggttcgtacggaacgggaccgtacggtacgttagtactttacgttacgcgtacgacgtactacgtacgttacgaacgtaacgcctaaggaccacggtacctaccgttaactacggttacccgtaacgggtaaccggtaccgggtaaaccgtaaccggtttacccgtaacccggttaaccgttaccgggtacccgtaacccgtaacccggtaccccgggtaccccctaaacccccgg

SEQ ID NO: 199440 - DNA, 996 bp, Homo sapiens
  misc_feature: GYAE6OF02GVQAV.18.59.F04.1.454.CMB.1.raw
  modified_base (249)..(249): a, c, t, g, unknown or other
  misc_feature (249)..(249): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctcgccctgactcagcctgacctcgtgtcgtgggtcctaccgtggacacggttcgatccgaaccattcctccgtgccacgtaggaaacccnggactagtacggtaccgttttaggggtacggttaactaaaccgtagttacgttccgtaccgttacgggtaacctaaaccgtacggacccgaacccgaacgggtaacccgaaaacccggaaccccccctaaaaaccgttccgtaaacgttaaccggttaaacgtttttaacgttacggtaccggtttaacggttaccctaaaccggttaacggttacccggggtacccccgtttacgggtttaacgggggttttaaacctaacggttaccgttacccgttttcgtaccggttaccggggtacccttaaccggttaacggtttaccgttacggggaacccgtaacgtaaccccggtcccgtaccccgtaggtaaccctacttcgtccggttacgggtcccgtacgacgggtactaccgggaaacgggtaccgtacgggtacgttaacgggttatttaacccgttagtacggaccgtacgtacgtaacccgtaattaaaccggttaacctaaccgggtaccctaaaccggtaccgttaacccgtaaccggtttaccttaaacgggtttcgttaaccggttttaccggtaaccgggggttaaccggttaacccggggttaaaaaccgtaccccgggggtttaaacccgtacccccggggttttaaccgttaacccggggttaacccgacccccggggttaaaacccccgggaacccgggttaaccccccctaaacccccggtttaacccgg

SEQ ID NO: 199441 - DNA, 599 bp, Homo sapiens
  misc_feature: GYAE6OF02F076F.18.59.F04.1.454.CMB.1.raw
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (519)..(519): a, c, t, g, unknown or other
  misc_feature (519)..(519): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgcctgactcagcctgcctccgtgtctgggtctccgtggacagtcgatcaccatctcctgcactggaaccagcagtgacgttggtgttaataactntgtctcctgtaccaanacgacaccagacaacgaccccaaactcatagtactttatagtatgtactaactaactccggtccctacggtacgggtttctaacgtcgtacttctacgtcgtctaccaagtcgtcgtacgaacgccggtcctacccgtacggacctactccgtacgtcgggcctaccgacggtcgagggaacgacggacgtcgtagtattacgtactgacctacgctacagttactaacgacgcacgacgaccactcctntacgtgttacgtacgacgtcggaacctacggtaccgtacgtccgtacggtcaccggtaccaaccggtacccacccgtacg

SEQ ID NO: 199442 - DNA, 773 bp, Homo sapiens
  misc_feature: GYAE6OF02HDM5D.18.59.F04.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatctcctgcactggaccngcagtgacgttggtgttataactntgtctctaggtaccaanacgcaccagaccaacgccccaaatcatagtatttanagtatgtactaacgtaacgtccgaccctaggtacggggtttacctaagttccgtctttactccgtacggacttaccgagttcgtggaccacgaccggtccctccgtacgacctacttccgtccggtcggtacctaccggtacggtcgtaggtaaccggggacgtacgggttaccttaacggttaaaccttttaggttaaacccgttcgggtaacctaacgggtacccctttaacgttaaccgtttaaacttaaaccgaaacgacccgtaaccgttaaacgacccttaacccgtttaccgtttaacgtttacgttaccggtttacccgggtttaaacggggttaacccggttaaccggggtaacccggttaaaccggttaaccccgttaacccgtttacccggttaacggtcccgaaacccgggttacccccaaacccggggtaccccctaaacccccggttaccgg

SEQ ID NO: 199443 - DNA, 687 bp, Homo sapiens
  misc_feature: GYAE6OF02HG8N2.18.59.F04.1.454.CMB.1.raw
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagcgtggtggagtcgtgggggaggcttgggtaaaagggtccgggggggttcccttaggaccttcccccgtgtaacacgccttcgtggtacttcgtacttttccgaggtaacggccgtggatggaacgttcgggtccgcaggcctcgaaggggaagggcgtggaggtgggtggaccgtaataaaccgaaactgagtggnggaacaanagactacgctagccgaccgagaagcagtacttaccacacgttacacaacgagatacgtaataacaaaaacgcgtaacgtcttagtactactcgaactaaagtgaaaccgacgacctaagggaacaaacggacgggtaacaacggtacgtacgtacgtttaattaaccgttccgaacctaacgttacccgtacctaagggaaacctaccggttaacgtaaaccttaaccttacgtaaccgttaacgtacgttcggaccgttcggacgggttaccgaaccggtacccg

SEQ ID NO: 199444 - DNA, 779 bp, Homo sapiens
  misc_feature: GYAE6OF02GWSM6.18.59.F04.1.454.CMB.1.raw
  modified_base (768)..(768): a, c, t, g, unknown or other
  misc_feature (768)..(768): n is a, c, g, or t
  modified_base (779)..(779): a, c, t, g, unknown or other
  misc_feature (779)..(779): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcacatctcctgcactggaaccagacagtgacgtttggtggttaataactagtgttctccgtaggtaaccaagacgccaacccgtagggacaaaacggaccccctaaaactcgaattcgtaatttagtgtaagtcgtacctaacttaacgtcccggtccctaggttacggggttttactaaacgttccggttacctttcgttaccgttgggtaccttaaccgtaacggttccggtacggaaccgtaaaaccggtccgggtccccttaaccccggtacgggtaacccttaacgtttccggtaccggttaccggggacctttacccggaacggggtaccgtttaacggggaacggtaccgggtaaacggttcgttaaggtttaactttaacgtttacgtcggaactacggttactacgtaaacgtaactaaccgaaccgaccacgtaacgccttaactcgtacttacgtacgttacgttacggtacgtacggaacgtacgtacgaccgtacgtacgtacgaccgtaccgaccgaacctaccgactcaacctccgtcgtacccttccgtcctacctctacgttcgtaccgtcgtacggtacggacggtcgtaccggacgtaacggcgtaacgtacgtgacncgagtctacgn

SEQ ID NO: 199445 - DNA, 724 bp, Homo sapiens
  misc_feature: GYAE6OF02GA3QS.18.59.F04.1.454.CMB.1.raw
  modified_base (186)..(186): a, c, t, g, unknown or other
  misc_feature (186)..(186): n is a, c, g, or t
  modified_base (333)..(333): a, c, t, g, unknown or other
  misc_feature (333)..(333): n is a, c, g, or t
tcagtacgagtatgcacgaccggtgctcgatttagtacacacacttagggagttggggtctgggagaggagccccagccttgggattcccaagtgtttcattcagtgatcaggactgaacacagaggactcaccatggagtttgggctgacgctggtattttccttgctgctattttaaaacggtntccagtgtgaggtgcagcgtaggtggacgtccgtgggggagtcgttagggtaaacgggcccgggggggttccttagacctccccgtgtaccacgcctcgtggacttcactttcgacgtaaggcctaggatcgaacgtcgggtacccnccgaggcctccggaaggggaacggggtcgtgggacggttcggggttacggaccggttaacgtaaaaaacccaaacgtggtaagttcgggtaacggggaaccaaacgtacgaaccgttacggccttaggaccgtacccggtaaggaaacgcgtaagtacttccgaacctactccagaagacgactagaattaacaaaacgctacgagttacgttactacgtagactaaagtacaacgtactacgtacgaacgtaaccgaggaaccaccgacggtaccgttaagttacgtacggtactaccctaacgtaccgtaacccgagtaaccgactaacccgtaaacttaccgttaacgtaccttacgggtactccggtaacttcggaccggaacccgg

SEQ ID NO: 199446 - DNA, 626 bp, Homo sapiens
  misc_feature: GYAE6OF02GLRQC.18.59.F04.1.454.CMB.1.raw
  modified_base (280)..(280): a, c, t, g, unknown or other
  misc_feature (280)..(280): n is a, c, g, or t
  modified_base (434)..(434): a, c, t, g, unknown or other
  misc_feature (434)..(434): n is a, c, g, or t
tcagtacgagtatgcacgaccggtgctcgatttagtacacacacttagggagttggggggctggggtctcaggaggccagcgctctcgggacgtctccaccatggcctgggctctgctattcctcaccctcctcactcagggcacgagggtccctgggcccagtctcgccctgactcagcctgcctccgtgtctgggtctccgtggacagtcgatcacctatctcctgcactggaaccagcagtgacgttggtgttataactatgtctcgtgtaccaacncgccaccgaggaccaaaccgacccccaaacactaatcgtatttatgatgtacaactacgtccggaccctgtacgggtttctaacgtcgtcttactcgtcgctcgtaagtcgcgacaacgccggtccctaccgcacctactctcgtcggctccgngtcgtacggacggacgacgtctagtacgtttaattctacgacgacgtactactaagtaactaacgagtacacgctactacgtaccgtagtacgttaccgttaacgggtaaccgtaccgggtaaccgtaacggtacccgtacggttacccgtaggtacccgaccggaccccgaaccggtaccccctaacccgg

SEQ ID NO: 199447 - DNA, 887 bp, Homo sapiens
  misc_feature: GYAE6OF02IC89Y.18.59.F04.1.454.CMB.1.raw
  modified_base (306)..(306): a, c, t, g, unknown or other
  misc_feature (306)..(306): n is a, c, g, or t
tcagtacgagtatgcacgaccggtgctcgatttagtacacacacttagggattgggggggggtctcaggaggcagcgctctcgggacgtctccaccatggcctgggctctgctattcctcacccctcctcactcagggcacgagggtcctgggcccagtctcgccctgactcacgccttgcccttccgtgttccgtggggttccttccgtagggacctaggttcggacttccacccgtattccttccctggccacgtacgggaacctgacctaggtggtacggtttgggtgtttaactaaacgttntgtcctccgttaggtaccaacgtacgccgacccaacggaccaaaccgtacccccctaaaacttaccgtacgttacggttaacttttacgtacggtaagttcggttaccctaaaccgtttaaaccggttccccgggtttacccctaacgggttttaaccggggttttacctaaacgtttccccgtaccgttttacccgttccggttaccgggtacccccttaaccggtaaacgtttccccggtaacggacccgtaaaaccccggtaccggggtacccccccgttttacccggtaacccgggtaaccctttaccgtttcccggtttaaccggtccccggggttacccttacccggggaacggttccccgtaaggggtaacccgggacgttacgggacgttaacggtttatttaaccggtttacccggtaccgaaccgttaccggtttactaacctcggtaacgtacgtcgggtacgaacgttacggtgtttacgggttcttagtttcgtaccgttagcgttacggcgtacgtaccggtacctcgttccgagttcgaacccgacgaccggtaccccaacgtccg

SEQ ID NO: 199448 - DNA, 829 bp, Homo sapiens
  misc_feature: GYAE6OF02FNVZB.18.59.F04.1.454.CMB.1.raw
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattgggggggggtctcaggaggcagcgctctcggggacgtctccaccatggcctgggctctgctattcctcaccctcctcactcagggcacgtacgggtcctggggcccaggtctgccctgactcagcctgcctccgtgtctgggttctccgtggacngttnactcacctacgtcctcctgacctacgtagggaaccagtanacggttcggtacggtttgggttagtttaactaacgtcgttcgtaccttccggtgtaaccccgtaagacggacctaccccgaaggaccgtaaacccgacccccctaaacgtacctaattacggtaaacttttcgagacgtttacgtaccgtaacgttaacggtccggtacccgttcgggtaacgggttttaacctaaacgttccggttaccttttacggtgttaccggtccttacccggtaacggtccgtacgtaccgtaaacccggcccggttacccctcccgttaccggaaccctttacgttcccggtttaccggtaccggggtaccgacccgtaacgggtacggtacgggtaccgggtaacgggtaaccgggtctaaccgggttaacgttttaaacgtaccggttacggtacccgtacggtaccgtttacctaagttacccgtaacaaacggtccaaaccggtacgtacccgtaattccgtaatccgttacttacccgtacggtacgtcgacccggtagtacccgtccgtacgtacgtccggttacccgacggtaacccgtacccgacctaccgg

SEQ ID NO: 199449 - DNA, 714 bp, Homo sapiens
  misc_feature: GYAE6OF02FS011.18.59.F04.1.454.CMB.1.raw
  modified_base (277)..(277): a, c, t, g, unknown or other
  misc_feature (277)..(277): n is a, c, g, or t
  modified_base (284)..(284): a, c, t, g, unknown or other
  misc_feature (284)..(284): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
tcagtacgagtatgcacgaccggtgctcgatttagtacacacacttagggattggggggctgggggtctcaggaggcagcgctctcgggacgtctccaccatggcctgggctctgctattcctcaccctcctcactcagggcacaggggtcctgggcccagtctgccctgactcaacctgcctccgtgtctgggtctcgtggacagtcgatcacctatcctccgtgcacgtggaaccagcagtgacgttggtgttatactatgtctctggtaccacngcacccnggcaaacgccccaaatcatnattngntgtacagtacgtcgccttgtagggtttcaatcgtcttcgtctcggcttaccgaagttcgtcggtacaacgtacccggtccctccgtcgaaccctatcctcgtaccgggtcctccgtacgggtctagggacggaccggtacggtaccttaggttaacttaacgtttaccgtcggtaacgtaccggttcttaactaacgttaaactacgtaacggtaccgtaagaaccgtaagaccccgttaattaacccgggtaacgtttaccccggttaacgggggtaaccgttaacgggggtaaaccccttaaacggggttaccccgtttaacccgggttacccgtttacgggaacccgtaacccggtaacccccggaacccggttaaccccccgtaaaccccgttaacccgg

SEQ ID NO: 199450 - DNA, 789 bp, Homo sapiens
  misc_feature: GYAE6OF02FV5SW.18.59.F04.1.454.CMB.1.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (738)..(738): a, c, t, g, unknown or other
  misc_feature (738)..(738): n is a, c, g, or t
  modified_base (742)..(742): a, c, t, g, unknown or other
  misc_feature (742)..(742): n is a, c, g, or t
  modified_base (778)..(778): a, c, t, g, unknown or other
  misc_feature (778)..(778): n is a, c, g, or t
  modified_base (785)..(785): a, c, t, g, unknown or other
  misc_feature (785)..(785): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggccaaagcccccaaactcatgatttangatgtcactaatccggccctntagggtttctaatcgtcttcgtctggcctaccaagtcctaggactaacgaccggtcctcccgcgaccaattcctccgtaggggcccttacgacggcctaggacgggaccgacggaccgtgtaacctttaagttaaccgttcggccgaacgtcctaacgtaattaaacttaacgaaacggtccaaacccgtaggtacccctaaatcctttacccgaagttcgttaaccctttacggggaaacccttacgggggaaaccctaaagggtttccctaacccgggttaacccgttacgggttaccaaaccgggtaccccgtaaaagggaccccccctaaacccccgaacctttacggtaaccccttaccgttaccgttcccgttacccccgttaaccccccttacccgttacccctaaaccctttaacccggttaccgttaaacccggtacggttaaccggggtacccgggtccggttaaccggggaacctaaccggggaccgtaaccgtagtttacggaccttagcgaatgtanacgntaactcagtacgcttacgacgtagtaggccgacgtntacgacnctac

SEQ ID NO: 199451 - DNA, 716 bp, Homo sapiens
  misc_feature: GYAE6OF02HLFPG.18.59.F04.1.454.CMB.1.raw
  modified_base (184)..(184): a, c, t, g, unknown or other
  misc_feature (184)..(184): n is a, c, g, or t
  modified_base (470)..(470): a, c, t, g, unknown or other
  misc_feature (470)..(470): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctctgctacgcggaaccagctagtagtacgttggtggttaataactntcgtctacgtcgtaaccaacgacgaccaccgaggaaccaaaccgaccccctaaatccagtagttattacgtagagtgtactataacgtccggtccgttaggtacggtttacctacgtccgtcgttaccgtcgtacggtactacggtctcggtaccgaacaccgaccccgtcacgactctactcggacgtccacggtggtcgagggaacgtacggtacgtagttaacgttagttaccgtacggctaccgtacgtaccgaactaacgttaacaacggacaagccgtanacgtacgtcgtaacgtacgtacgtaccgtaacggacgtacgtaactacgtacgttacgtacgtaccgaccgtaaccgacccgtaaccgtaccgtactacgtaaccgtacttcccgtacccgttccctacccgtaccgtacctaccgttaaccgttacgtacccgagtacccgtccggtacggtaccggtaacggtaccggacgtaccgtaacgtgtaccttaggaccacggtaacctcgtcgtacg

SEQ ID NO: 199452 - DNA, 735 bp, Homo sapiens
  misc_feature: GYAE6OF02JTFO4.18.59.F04.1.454.CMB.1.raw
  modified_base (248)..(248): a, c, t, g, unknown or other
  misc_feature (248)..(248): n is a, c, g, or t
tcagtacgagtatgcacgaccggtgctcgatttagtacacacacttagggatgggggggggtctcaggaggcagcgctctcgggacgtctccaccatggcctgggctctgctattcctccaccctcctcactcagggctacgacgggtccgtcgggcccaggtctcgccctgactcacgcctgcctcgtgtctcgggtctccgtaggactcgtcgactcacccatccgtcctgcctacgtcggaaccncgcgtacggtcggtacggtttgggtacgttataactgttacgtcgtaccgtacggtaaccaaccgacgtacccgaccgtacggaacctaaccgaccccctaaactcctaagtacgttaatttagtcgtattacgtacctaagtaccgtccgtaccgtacggttaacggttacttaaccgtcgttaccgttaccgttacgtcggtacctacgtaacggtcgtacggtaacccgacctaaccggtccctacccgtaaccgacctacgttccgtcgggtcggtcccgtaggtccggacgtaccggacggtacggtaaccgttgtaccgttaagttacttacggcgtactcgtacagttaataacgtaccgacgtacaccgtctacttcgtactacgtccttcgtaccgtaccggtgtaacccggtaaggtacccgtacccgttaccgtaccggtaccgtacgaccgaccgtaccgaccccttacggtacg

SEQ ID NO: 199453 - DNA, 729 bp, Homo sapiens
  misc_feature: GYAE6OF02I78IZ.18.59.F04.1.454.CMB.1.raw
  modified_base (698)..(698): a, c, t, g, unknown or other
  misc_feature (698)..(698): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatcggaagtttgggactgagctggattttccttgctgctattttaaaggtgtccagtgtgagtgcagctggtgagtctggggaggcttggtaagccggggggtccttagactccctgtacagtcctctggattcactttcgaggttaacggcctaggactaggaactggggtccacgaggtcctaccggaagggtaacgggggcctaggggacggtcgggggttaggccggttaacttaaaaaccgaaaacgtggtaagtgggttacgggaacaacgacgtaactacgcgtagccgaacccgtagaaacggcgaagtacttcccgaacctacgtaccaacgaacgtaagacttaaggacttaaacgaaaaacgccgtacgtaacctagtacttacgttacgaaccgtaaagttacgaaacctacgttacccgaggtaaaccgtaaaccggacgaaaccggacgtaacgaccggttacttaacggttcctaaaggtacccctagtacccgtacccgtagtaaacccgtcggtaacctaacgtaccttaaccgtactttaaccggntacccgggtactccggttacgggtaacccgg

SEQ ID NO: 199454 - DNA, 953 bp, Homo sapiens
  misc_feature: GYAE6OF02H8GEA.18.59.F04.1.454.CMB.1.raw
tcagtacgagtatgcacgaccggtgctcgatttagtacacacacttagggattgggggggagaggagccccagccttgggattcccaagttgttttcattcagtgatcaggactgaacacagaggactcaccatggagtttgggctgagcgtggtattttccttgctgcttaattttaaaaggtgtccagtgtgaggtgcagcgtggtggtagtcgtgggggagtcgttagggtaaaggccggggggtaccttaggacctccccgtgtacacgcctcgtggtacttcactttacgagttaacggcctaggataggaacgtgggtccccgacgaggcctaccggaagggaacggggtcgtagggtaaggttggggttacggaccggttaaacgtttaaaaaacccgtaaaacgtggtaacggttaggggtaacgggtaaaccaaacgaaggtaaccgtaacggtccgtacggtaccctaaccccggtaaggaaaaccgggtacgtaaacggtaactttacccctaaccgaacgttcctaaaccggtaaagtaacggttaacgttaacggtaaacgtttaaaccggaaaaaaacgtccgtaaaccggtaccgttaagttaaccgttaccgtaacgtaaacgtaaaacgttaacgtaaaccgtaaccgtacccgttaaagaaaccggggtaaacccgaaacgggtaaccgtaaaccggtacggttaacccgggttaacggtttaaacccgtttaaacccgttaccggtaaaccccgttaaaccgtaacccgttaacccccgtaacgtaaacccggtaccgttaaaccctaaaaacccgtttaacccgttaaaaaccccgtttaacccggttaacccgggttaacgttaacccgggtaccccggtttaccgggtaacccgggggtaacccccggtaaacgggggttaaaccccccgg

SEQ ID NO: 199455 - DNA, 637 bp, Homo sapiens
  misc_feature: GYAE6OF02G8M6U.18.59.F04.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (457)..(457): a, c, t, g, unknown or other
  misc_feature (457)..(457): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatcctctgcactcggaaccngcagtgacgttggtgttatactntgtctcctgtaccaacagcaccagacaacgacccccaaactcatagtatttagtgatgtacaactaacgtccggccctacgtacggggtttactaacgttccgtcttctcgtcgacctccgaagtctcggaccaacgtaccggtcccttccctcgaaccctactcctccgtcggtaccctaccgagtcgtacggacgggacggnggtccgtagttaacgttaacgtttacttgacctacgtctagtaacttaacgtaactaacgacaaccgacaccgtactcttactatcgttaccgttacggtaacggtcggaaccgtaacggtaccgaccgttccgtaacgttaccggacctaaccccggaaccgcccgtaaccccgtaccg

SEQ ID NO: 199456 - DNA, 596 bp, Homo sapiens
  misc_feature: GYAE6OF02GGO5G.18.59.F04.1.454.CMB.1.raw
  modified_base (357)..(357): a, c, t, g, unknown or other
  misc_feature (357)..(357): n is a, c, g, or t
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtgttataactatgtctcctggtaccaacagcacccaggacaaacgcccccaaagtcatgatttatgatcgtcactaatcggccctcgtaggggtttctaatcgtcttctctgctaccaagtctggacaacacggtcctcccgtgaccatcctcgtgggcctccgaggctgaggacgagctgattatactncagcacgtaatatacaagcaccagcctactctactatgttcgtacggaacgtgggaacctaacggtacctaccggtaccttaggtacacgacccgtaaacgaccccgaaacccctagtacgtaccaccgttccttaccggttcccccgtacccctaccctacctaacttaaccgttcgtaacgtcgacgggtccgggcgtacgggacgaacggaccgagtaacgtcgatnacgtnancg

SEQ ID NO: 199457 - DNA, 738 bp, Homo sapiens
  misc_feature: GYAE6OF02GPFPS.18.59.F04.1.454.CMB.1.raw
  modified_base (736)..(736): a, c, t, g, unknown or other
  misc_feature (736)..(736): n is a, c, g, or t
tcagtacgagtatgcacgaccggtgctcgatttagtacacacacttagggtagttgggggctttgcctggggtcctgggcccagtctgccctgactcagcctgcctccgtgtctgggtctcctggacagtcgatcaccatctcctgcgactggaaccagcagtgacgttggtggttataactatgtctcctggtaccaactagcacccaggcaaacgcccccaaactcatagatttactgatcgtacactaaatccggccctcgtaggggtttactaactccgcttactcgtggcctcctaagtctggccaacaccggcctaccctcgacctactcgtacgtggcctcgacggctacggacggacgacggtctacgtattacgttacgtgtacacgtcctactaacgtaacttaaccgaacgacctaacccgacgtaccgtaaccttccttacgttacgttccgtttacccgttaaacggtaaccggttacgggaaacccgtaccggttacccgtacccggttacccggttaacggttccgacccgacccgaacccggaacccctaaccccgtacgttaccgtaccctccgttaccgttaccccgtttaccccgccctttaccctacccgttaaccgttccgttaaccgttaccgtccggtaccgggtaccggttccggtaacggacccggtaacgggtacccgtacgttaacggttacgacttcgacggtctacncg

SEQ ID NO: 199458 - DNA, 720 bp, Homo sapiens
  misc_feature: GYAE6OF02GBR6P.18.59.F04.1.454.CMB.1.raw
  modified_base (232)..(232): a, c, t, g, unknown or other
  misc_feature (232)..(232): n is a, c, g, or t
  modified_base (548)..(548): a, c, t, g, unknown or other
  misc_feature (548)..(548): n is a, c, g, or t
  modified_base (589)..(589): a, c, t, g, unknown or other
  misc_feature (589)..(589): n is a, c, g, or t
  modified_base (601)..(601): a, c, t, g, unknown or other
  misc_feature (601)..(601): n is a, c, g, or t
  modified_base (606)..(606): a, c, t, g, unknown or other
  misc_feature (606)..(606): n is a, c, g, or t
  modified_base (612)..(612): a, c, t, g, unknown or other
  misc_feature (612)..(612): n is a, c, g, or t
tcagtacgagtatgcacgaccggtgctcgatttagtacacacacttagggattggggggggggtctcaggaggcagcgctctcggggacgtctccaccatggcctgggctctgctattcctcaccctcctcactcagggcacgagggtcctgggcccagtctcgccctgactcagcctgcctccgtgtcgtcgggtctccgtggacagtcgactccaccgtacttccttccngacctacgtacggaaccctagacctagggttcggtacgggttttgggttagggtttaaacttaaaccttgttcgttccttaccgttacgggtaaccaactaaccgacccgaaccccgaacggaccaaaccgacccccaaacctactaacgtacgttaatttgagtactcgtaacctaacgttaaccgtcccggtcccggtttacggttacggggtttaccttaagtccgttacgttcttcggtaccgtcctaaccgttacgtacgtacggacctaaccgccgttaccctccgtacgtacctcgtccgtcggcgtcncggcgtcggagtacggagtacgtctagttattactcgtgcngtctacgtatanaccanacctanactctactcttacggtcttacgttacggtacggtacggtacggtaacgtaccggtacccgtacgtaccggtacgtacgcccgaaccgaccctacccgtaccttaccgg

SEQ ID NO: 199459 - DNA, 823 bp, Homo sapiens
  misc_feature: GYAE6OF02IN2HR.18.59.F04.1.454.CMB.1.raw
  modified_base (350)..(350): a, c, t, g, unknown or other
  misc_feature (350)..(350): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcacctactcttcctgcctacgtcggaaccaggctagtcggtacggttgggttaggttaactaacttatcgttctccgtacggtaaccaacgacgccaaccgacggaccaaaccgacccccctaaactacgacttagtacttttagngtaacttgtaacgtaacggtaacgttccggtacccgttacggttaacggggttttactaacgttaccgtccgtttaccgttcgtccggtaccttaccggtaacgttccgtacggacctaaaccgtacccgtacccttacccggtaccgtaaccgtacgttccgttaccggtcgggtaccctaccggacggtaccggaggggtaacggtaccggggtacgggttctacggtttaacgttttaacgtaccgacggttaccacgttacctaccggttaacgttaaacgtaacggaacgtacgtaacgaccgtagtaccccgtaacgttaaccggttaacgttaccgggttaaccggtaaccgggttaccgggtaaaacccgtaaccgggttacccttaacccggggttaccttaaccgggtaccggacccgtaacccggtaaccccggaaccccttaaccccggtggttaaccccg

SEQ ID NO: 199460 - DNA, 786 bp, Homo sapiens
  misc_feature: GYAE6OF02IRK5Z.18.59.F04.1.454.CMB.1.raw
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
tcagtacgagtatgcacgaccggtgctcgatttagtacacacacttagggaagttggggggggtctcaggaggcagcgcctctcgggacgtctccaccatggcctgggctctgctattcctcaccctcctcactcagggcacgagggtcctgggcccagtctgccctgacctcacgtcctgccttccgtgtccgtgggtctccgtggactagtcatccacatctcctgacacgtgaaccngcagtcgtacgttggtagttaactaactntcgttactccgtacggtaacctaacacgaccaaccgacggacaaaccgtaccccaaaactctaatacgtatttacgtagtactcgtactaacgtaacgttccgtacccgttacggttacggttttaactacgttccttccgtttctaccggtcggtacctaccgtaacgttacgtcgaaccgtaaaccgtaccggtacccttacccgtacggtaacctacgtttaccggtcgttcccgggtaacctccgggtaacggtaccgggttaggaaacgggtccggtaacgggtaccgtttaacgttaaacgttttacgttacgtcgtaacgtacgtaccttactaagttaccgtaaacgacgtaacccgaaccgtacgtaccttaacgttccttaaacttcgtttaccgttaccggttaaccgggtaaccggttacggaaaccctacgggttaacccgttaaccggtacccgtacggtacccgtaccggaaccccgtaacccgtaacccctcccgttaacg

SEQ ID NO: 199461 - DNA, 835 bp, Homo sapiens
  misc_feature: GYAE6OF02FPFE3.18.59.F04.1.454.CMB.1.raw
  modified_base (127)..(127): a, c, t, g, unknown or other
  misc_feature (127)..(127): n is a, c, g, or t
  modified_base (184)..(184): a, c, t, g, unknown or other
  misc_feature (184)..(184): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctccncactcaggcacgagggtcctgggcccagtctcgcccttgactcgagcctgcctccgngtcgtcggtcctcgtcggactacgtcgactaccacctattccgacctgacctacggttacggaaaccngtaccgtaggttacggtaaccggttttgggttaacggttaaacttaaaccgtgtttaccgtccgttaccgttaacggtaaccctaacgacgaaccgaacccggacgaaaccgtaaaccccgtaccccctaaaacgtcgtaacttaggtttaattaacgtagttaacgtcgtaaccttaaaccgttaccgtcccggtacccgtttacgggttacgggtttaacctacgtccgttctttaccgtggttaccggtccttaaccggtaacgttccggtaacgaccaccggtcccgtacccgttccgtacgtaaccgtacgtccgttacggttacggaccctcgggtaacggtacgtacgggaacggttacgggacgttacggtttaattaaccggttaattccggttacgactaaccgggttattaccgtaaagttaccaacgtaccggtccaacgtaccgtaactttaccgcttacggttacgttcgttaccggttaacgacggttaccgggaaccgttaccggtacccgtacgttaccggtaaccggtctaaaccgggccctaacccggtacctaacccgttccg

SEQ ID NO: 199462 - DNA, 901 bp, Homo sapiens
  misc_feature: GYAE6OF02GWSEE.18.59.F04.1.454.CMB.1.raw
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacggttggtggttataactatgtctcctggtaccaacagcacccaggccaaacgcccccaaactcatgtatttaatgatgtacactaagtccggccctcgtaggggtttactaacgtccgtcttctcgtcggccttaccgaaggttcgtacggaccaaccgaccggtccctacccgtacgtaacccgtacttccgtcggttccgggtaccgtacccgacgggtaccgttacgggaacgggtaaccgggtacggtaccgttaggtaacgttttaacttaccgtcggaaccgtacggtccttaccgtaaacgttaaactaacgtaaaccgtacccaaacccggtaaccgtacccttaaccgttacctttacgttaacgtttaccggtttaacccggtttaacccggggtaaaccgggttacccggggtaaaacccttaacggggttaacccccgtaaccccgggttaacccggtttaccggggtaaccccgtaacccggtaacccccgggtaaaacccgggaaccccctaaacccccggttaacggtttacccgttaacccgttaacccgttttccccggttaccccgtttacccccctaccccctttacccgttaacccttaaacccgttaacccggttacccggttacgtaccgggaccgggttacccggggtaacccggttaccgggaacggtaaccgggtacccgtaaacgttacgtacgaacgcgtagtaccagtacg

SEQ ID NO: 199463 - DNA, 556 bp, Homo sapiens
  misc_feature: GYAE6OF02FTVPJ.18.59.F04.1.454.CMB.1.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
  modified_base (365)..(365): a, c, t, g, unknown or other
  misc_feature (365)..(365): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
tcagtacgagtatgcacgaccggtgctcgatttagtacacacacttaggagtggggggggtctcaggaggcagcgcctcgtcgggtacgtctccgacctatggccgtgggctctagctattcctacaccctcctcactcagggactacgagggtcctgggccctagtcttgccctgactctaggcctgcctcgtgtctgggtctcctggactgtcgatcctacntctctgctactggaaccngcagtgtacgtggtgtatactgtctctctgtaccactgccaccgngactaacgccccaatcatcgattngagtgtcactacgtccgactcgtaggttctaactcgtctctctgtctacagtcncgacacgtacgcctcncgtcntctcgtggctcgntcgagcgtacgngtctagtacttacgtactagctacgtactaccaataccgataaccgactacgcgtactactcgttcgttacgtcgttcgcgtacgtcggtacctcggtccgtaccgtcggtcgtaccgaccgtacccgaacgtccccaacctcgg

SEQ ID NO: 199464 - DNA, 672 bp, Homo sapiens
  misc_feature: GYAE6OF02H0GGL.18.59.F04.1.454.CMB.1.raw
  modified_base (552)..(552): a, c, t, g, unknown or other
  misc_feature (552)..(552): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctcgggcccagtctcgccctgactcacgcctgcctccgtgtcgtcgggtctcctggacacgtcgactcaccactctcctgcacgtcggaaccagcagtgtacggttggtaggttaataactagttcgttcctccgtacggtaaccaacgacgaccaaccgaacggaaccaaaacccggaccccctaaaactccaagttacgtaacttttatagtattcgtaactaaccttaacgtcccggtacccgttacggttacgggtttactaagttccgtctttacgtcgtacggtcctacgaacgtcgtacggaccaacgtccggtccctacccgtacgacctacgttccgtacggtccggcctaccgacggtcgtaggacggacgacgtacttgtaacttacgtagacncgagtactctaagtacagacaccgacacgtacctctactcgtatcgttacgacggtacgtaacggtaccacgggtacctacgtcgtacgtccgaaccgaccgaaccgaccctaccgtacg

SEQ ID NO: 199465 - DNA, 923 bp, Homo sapiens
  misc_feature: GYAE6OF02IZH6A.18.59.F04.1.454.CMB.1.raw
  modified_base (179)..(179): a, c, t, g, unknown or other
  misc_feature (179)..(179): n is a, c, g, or t
  modified_base (902)..(902): a, c, t, g, unknown or other
  misc_feature (902)..(902): n is a, c, g, or t
tcagtacgagtatgcacgaccggtgctcgatttagtacacacacttagggattggggtctgggagaggagccccagccttgggattcccaagtgtttcattcagtgatcaggactgaacacagaggactccaccatggtagttgggctgagcgtggtatttctgctgctaagtttaagngtcagtgtgaggtgcagcgtggtggaggtcggtgggggaggtacgttaggggtaaacgggtcccgggggggttaccccttaaggacccgttccccgtaggtaccgacggtaccctcgtaggtacttcctaccgttttcgaaggtacggtccgtaggacgttacggtaacgtcggggtacccgcgtacggccgtaccggaagggggtaacgggggtcgtgggtaggggttgggggttacgggtaaccgttaaaacgttaaaaaccgaaaaccgtttggaaggttcggggtaacggaaccgtaaaacgtaaccggaacttaaccgggccttaacggaccccgtaaccggttaagggaaaaccgtcgaacggttaacgttacccgaactaacgttaccgaaacgttaagggaataaccgtaaacgtaaacgtttaaacccgaaaaaacgtccgtaaccggttaactacgggttaaccttacgggtacaaaccggttaaaacgttacggaaccccgttacgtaaaccgggtaacgtaaaccgggaaaccggtaaacccggaaccgaaccggttaaaccggtcccggttttaactttaaagggttacccttacgggttaaacccctaacttaccccgttaacccggttaagtaaaacccggtaccgttaaaccaaccgtttaaccgaaccgtttaaccggtacgggttaactcccgggtttaacccgngggtaacccgggtaaccccgg

SEQ ID NO: 199466 - DNA, 737 bp, Homo sapiens
  misc_feature: GYAE6OF02F61WG.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgttctcctggtaaccaacagccacccaggacaaacgccccccaaactcaatgtatttatgattgtactacttaacgtccggtacccgtcgtacggggtttactaacgttcgtaccgtttctctcgggtccttaccgtaagttccgtacggaccaaaccgtacccgggtccccttaccccgtacggaccctacttccgttccggtcgggtccctccgacgggtccgtacggaacgggaccgggacggtaccgttacggttaattttaaccgttaccgttcggaccgtaacgtaccttacgtaacttaacgtaaccgaacgtacccaaccgtacgtaccctacttcccgttacttacgttccgttaccggtttaaccggtaacggttaccggggaacccgtaacgggttccccgtaacccggtttccggttacggtacccgaacccgaccccggtaaccgggaccccctaaccccgttaaccgg

SEQ ID NO: 199467 - DNA, 762 bp, Homo sapiens
  misc_feature: GYAE6OF02F8L58.18.59.F04.1.454.CMB.1.raw
tcagtacgagtatgcacgaccggtgctcgatttagtacacacacttagggattggggggggggtctcaggaggcagcgctctcgggacgtctccaccatggcctgggctctgctattcctcaccctcctcactcagggcacgagggtcctgggcccagtctgccctgactcagcctgcctccgtgtcgtgggtcctccgtggacagtcgatccaacctatcctcctggcctacgtcggaaccagcagtggtacgtttgggtagtttaataacgtattcgttccttccgtacggtaaccaacgacgacctaccccgaacggaccaaacccggaccccccaaaactccaagtacgttatttagtacgtattgtacctaacgttaacgtccggtaccctcggttacggggttttacctaacgtcgttacctttcgtacgtcgtacctaccgtaacgtcgtacggacctaaccgaccggtccctcccgtacgtacctactaccgtcgtcggtcctaccggtaggtcgtacggtacgggacggtacggtactagttactttaacgttacgacgtaccgtacgtaccttactaacgttaacgtaaaccaccgtaccgaaccgaacgtcccttaacttccgttataccgttagtttacccggtacggtacggtacccgggtaaccgttaccgggtacccttaccggttaccgttacccggtaccgtaacccggaaccccgtaaccggtacccccgtacccttaacccgg

SEQ ID NO: 199468 - DNA, 719 bp, Homo sapiens
  misc_feature: GYAE6OF02JNJY1.18.59.F04.1.454.CMB.1.raw
  modified_base (161)..(161): a, c, t, g, unknown or other
  misc_feature (161)..(161): n is a, c, g, or t
  modified_base (241)..(241): a, c, t, g, unknown or other
  misc_feature (241)..(241): n is a, c, g, or t
  modified_base (558)..(558): a, c, t, g, unknown or other
  misc_feature (558)..(558): n is a, c, g, or t
tcagtacgagtatgcacgaccggtgctcgatttagtacacacacttaggattgggggcgtggggtctcaggaggcagcgctctcgggacgtctccaccatggcctcgggctctgctattcctcaccctcctcactcaggcacaggtcctcggcccagtctncccctgactcagcctcgcctccgtgtctgggtctacctggacagtcgactcaccgtactctcctgccacgtggaaacccngtccagtggtaccggttggtacggttttaagtaacttagtcgtctaccgttcggttaaccaacgaacgcaacccctacggaacgaaacccaacccccgaaacctacctagtacgttaactttaagtacgtacttgtacctaacgtaacttcggtaccccttcggtacgggttttacaattccgtctacgttctcggtctacagtccgtagccaaccgtccggtccctcccgtacgactaccttactacggtcggtaccgtcgaccggtcgtacgagggtaaacggtcggtctacggttattaacggtcttcggtacncgttacgtacctattacccgtaacaaaccggattaacccgaggaaccgttaccgtaccttacgttacgtttacgttccggttaacggaccggttaaccggacccgttaacggtaccgttacccgtcggacggttaccgacccgtaccggaaccctaccccg

SEQ ID NO: 199469 - DNA, 769 bp, Homo sapiens
  misc_feature: GYAE6OF02I1T4A.18.59.F04.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtaggacagtcgatccaccatcctcctgcacgtggaaccngcagtgacgttggtgttataactntgtctccgtggtaaccaatacgcaccgaggcaaaccgacccccaatcatggtaactttatggtatcgtactaagtaacgtcccggtacctacggttacgggtttactaacgttccggtacctttacgtccgtcgggtacctaccgtaaaggttcccgtacggaccgtaaacccggtccgggtacccccttacccgtacgtaacccctacgttcccggtttaccggtacggggtaccccttaccggaccgggtaccgttagggaacgggtaccggacgggtaccttagttaacgtttaacgtttaccgccggacgttaccgtacttaaccgtaaattaacgtaaccgaaggaaccgacgaaccgtacgaaccttaaccgtaacgtaacgttttccgggtaccggtaaaccggttacgggaaacccgtaccgggttaaccctaacccggttacgttaccggtaacccgaccgaacccccggtaaaccggccccctaacccgtcgttaacccgg

SEQ ID NO: 199470 - DNA, 930 bp, Homo sapiens
  misc_feature: GYAE6OF02JMHXN.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggtattttcctgctgtctattttaaaggtgtccagtgtgaggtgcagctggtggagtcgtgggggagtcgttaggtaaacgggtccggggggtcccgttacgaccgtaccccgtgtaccgacgtccgtcgtggtaacttctactttacgaggtaacggccgtaggtactaggtaaccgtcgggtcccgaccgtacggccgtacccggaagggggtaacggggccgtaggggtacgggttcggggttacgggtaacccggttaaaacgtttaaaaaacccgtaaaacggtacggtaaggttacggggttaacggtaaccgaacgtaacggtaaccgttaaccgggccgttacggaacccgtaacccggtaaacggaaacgggtaccgtaaacgtaccgtttaacccgaaccgtacgttaccgtaacgaaacggttaaacgtagtttaaaccgaaaatttaaaacccgaaaaaacgggtcccgtaaaccggtttccgttaaatttaaaccggttccttaaggtaaccttaaaaagttaacccggaaacgtaccgttaaccgagggaaaacccgggtaaaccggaacgtacccgtaaagaccgggttacccgttaaggttaacctttaaaacgtcccgttaacccgtaaccgtaaccgttcccccgtaacggtaaaacggttaccttaacccgttaaaccgttaacccgtttaacccgttaacccgtaacgggttacgttaccccggacccggtttaacgggttccccgggaaaacccgg

SEQ ID NO: 199471 - DNA, 859 bp, Homo sapiens
  misc_feature: GYAE6OF02FRXN1.18.59.F04.1.454.CMB.1.raw
  modified_base (338)..(338): a, c, t, g, unknown or other
  misc_feature (338)..(338): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttggctgagctggattttcctgctgctattttaaaggtgtccagtgtgaggtgcagctggtggagtcgtggggaggcgttggtaaggccggggggtcctcgacctccctgtacacgtcctacgtggacttcgactttacgagtaaggccgtggactcgaacgtggtcccgccgagcgtaccgaggggacgggcgtagggnggttcgggttaggccggtaaacgttaaaccgtaaaaccgtaggacgtcgggtacgggtaacaacgtgaaccgtaggcgttcgccgtaaccggtcggaaacgcgtagtacctcgaactacgtactacgaacggtagtaacgtagtaaacgtttacaaaaaacgtccgtaacccgacgttaaccgttacggttacgttaaccgaacgttaaaacgtacggtaaaccggtacgtaacccggtaacgaaccggtaaaccgggaacgggtaaacccgtaaccggaccggtaacccgggttacgtttaaccggtttaaccggttaaacccgtaccgttaaaccctaacccggtttacccccggtaaaccggttaacggtaaccccgggttaaacccggtaaaccctttaacccggttaaaccccgttttaaccccgttaaaccggtttaaccggggttacccgttaacccgggtttacccggggtacccggggttaccccggggaaacgggggttaaaccccccggg

SEQ ID NO: 199472 - DNA, 668 bp, Homo sapiens
  misc_feature: GYAE6OF02IZVQ1.18.59.F04.1.454.CMB.1.raw
  modified_base (160)..(160): a, c, t, g, unknown or other
  misc_feature (160)..(160): n is a, c, g, or t
  modified_base (189)..(189): a, c, t, g, unknown or other
  misc_feature (189)..(189): n is a, c, g, or t
  modified_base (226)..(226): a, c, t, g, unknown or other
  misc_feature (226)..(226): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (395)..(395): a, c, t, g, unknown or other
  misc_feature (395)..(395): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctccgtgcactggaaccagcagngacgtggtgtatactatgtctctgacaangacaccaggacaaacgccccaaatcatgatttatgangtcactaagtccgtcctagtagggttcaatcgtctcgtctaggctccaagttcgngacgaactccggccctccngaaccntctacgtcggctaccgaggtcaggacggaacgnggtcngtattatacgngtaccatccataatagtaacaagacacacgcctaacttcncgtaattcgtacctttacgggctaacgggacttacgggaccttacgtacccgtagggtccacgacccggtaacgacccaaccctagtaacgtccgtaccgtttacctcccggttaaccccctaccccttacccgggtaacctaacccgttacccggtttaacccgaatttccgggaaacggggtccccgtttaacccggggtaggaacccccggtttaaggcccggtttaacccaagggtttacccggactaacggtttacaacgttacgacg

SEQ ID NO: 199473 - DNA, 837 bp, Homo sapiens
  misc_feature: GYAE6OF02H3I93.18.59.F04.1.454.CMB.1.raw
  modified_base (232)..(232): a, c, t, g, unknown or other
  misc_feature (232)..(232): n is a, c, g, or t
tcagtacgagtatgcacgaccggtgctcgatttagtacacacacttagggattgggggggggtctcaggaggcagcgctctcgggacgtctccaccatggcctgggctctgctattcctcacctcctcactcgagggcacgagggtcctgggcccagtctcgccctgactcagcctgcctcgtgtctgggtctcgtggacagtcgatcaccatctcctgctacgtggaaccngcagtcgtacgttggtaggttaataactagttggttacctccgttaggtaacccaagtacgaccaacccgaggaccaaaaccggaccccccaaaagtccaattggtaacttttagtcggtattacggttctaaaccgttaacgttccggtaccccttacggttaacggggtttactaaacgttccgtccgttttccgtaccgttcgggtacctacccgtaaggtttccgttacgggaacctaaccgaacccgggtccccttaccccgtagtaaccctacgtttcccgttccggtccggggtccttcccggtaacgggtcggttacgggacgggtaccgggtaggtacccgttagttaacgttttaacttacgtacggtacgtacgtcgtaaccgtaattaaaccgtaaaccgtaacgtacccgtaaccgaacggtacccttaaacccgtccgtttaaccgttaacgtttaccggtttaccggtttaccggtaacgggttaacgggtaaccccggtaaccgggttacccgtaacccggttaccgttaacgggtaccgtacccggttaaccccgaaacccgggttacccccgaacccgttaacccgg

SEQ ID NO: 199474 - DNA, 626 bp, Homo sapiens
  misc_feature: GYAE6OF02GDER7.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggccccagtctgccctgactcagcctgcctccgtgtctgggtctctggacagtcgatcaccatctcctgcactggaaccagcagtgacgttggtggttataactatgtctcctggtaccaacagccacccaggacaaacgacccccaaactcatgtattaatgatgtacactaatccggccctcgtagggtttactaatcgtcttctctgctcagtctggacaacgcgtccctcctcgacctatctcgtcgggcctcgacgcgtggaggacgaggctagtactttatacgtgactagactactataactaacgaacgccaaccgaagtccaacttccctacttacgttacgttaccgttacggaacggttaccggggaaacccttaaccgggttacccgtaacccggtttacccggtaacgggtacccgtaacccggtaaccccggaacccgggtaccccctaaacccccgtaccgg

SEQ ID NO: 199475 - DNA, 683 bp, Homo sapiens
  misc_feature: GYAE6OF02FGGH3.18.59.F04.1.454.CMB.1.raw
  modified_base (642)..(642): a, c, t, g, unknown or other
  misc_feature (642)..(642): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcaggcacagggtcctgggcccagtctcgccctgactcagcctgcctccgtgtctcgggtcctcctggacagtcgatccaccgatctcctagcaccgtggaaccacgcaaggttcggtacgttgggttacggttaataaacctgttcggtccttacctggttaacccaacacgaccgaccccgaagggaacccaaaccgcccccctaaactctaacgtagttaactttatgtaactcgtacgtaacgttaacgtcccggtacccgtacggttacggggtttaccttaacgtcgttccttcgttctacggccttaccgtaagtcgtacggaccaaccgacccgtccctcccgtacgtacctactccgtcgttacgggacctcgaacggtcggtgaacggcggtacggctagttactttacacttcgacgtacgtacctacgtaaattaccaacgtaacgacctaaccgacgtaccacttactctagttaccgttcgacgtacggtacggaaccncgtaccgcctagtaccgcaccgtaccacgacccaccgtacg

SEQ ID NO: 199476 - DNA, 760 bp, Homo sapiens
  misc_feature: GYAE6OF02FQDQ4.18.59.F04.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (276)..(276): a, c, t, g, unknown or other
  misc_feature (276)..(276): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcacgcctgcctcgtgtctggtctccgtggacngtcgatcaccntcctctgcactggaaccngcagtgacggtttggtggttaataactatgtctcctggtaccaancgacaccgaggacaaacgaccccaactcactagtatttatgtattgtacaactaacgtccggtaccccgttcgtacgggtttactaacgtcctaccttctcgtacggtcctacgtaacgttcgtacggtaccaaccgtacccggtcccttacccgtacggtaccctacgttcccgtccgggttacgggccgtacccgtacggtccggtagggaccgggtaacgggtcggttacggttacgttaaacgttttacgttaacggttcgaccgttacgaccgttacgtaacttaaactaccgtaaacgaccctaaaccggtaccgtaccgtaaccttaccgtttaccgtttaacggttcccggtttaacggtttaaacccggggaacccggtttaaccggggtaaccgtaacccggtttacccgacccggtttaaaccgttcccggggtaacccctaaccgggacccccgaaccggttaacccccccg

SEQ ID NO: 199477 - DNA, 660 bp, Homo sapiens
  misc_feature: GYAE6OF02HPGNV.18.59.F04.1.454.CMB.1.raw
  modified_base (422)..(422): a, c, t, g, unknown or other
  misc_feature (422)..(422): n is a, c, g, or t
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
tcagtacgagtatgcacgaccggtgctcgatttagtacacacacttaggaattgggggctgggggtctcaggaggcagtgctctcgggacgtctccaccatggcctgggctctgctattcctcaccctcctcactcatggcactaggggtcctcgggacccagtcctgccctgactcagcctggcctccgtgtcgtggtctccgtggacagtcgatcaactactcttccgtagcaactacgggaaacctaggacctagggtgtaacggtttgggtaggttaactaacgttagtcgtctaccgtacggtaaccaacgacgaccgtaaccgacggtacctaaaccgtaccccctaaatcaactagtattatgtagtcgtaaccactaactccggaccgtagtagggttactaagtcgtaccttnacgtcgtacgtacgtacgtacgtagtaccgaacggacccgtacgttacccgacgtacctacgttctaccgtggtacctacggacgacggtaggaacgggtacgacggttctagttattagtccgtagcgtacgctatacgtaacacgacgacacganacgtacnctacttactgtaaccgtaggaacgtacggaccgtacgtacctcggtaccgttacggacggtaccaccgtaaccg

SEQ ID NO: 199478 - DNA, 825 bp, Homo sapiens
  misc_feature: GYAE6OF02HUD7A.18.59.F04.1.454.CMB.1.raw
  modified_base (243)..(243): a, c, t, g, unknown or other
  misc_feature (243)..(243): n is a, c, g, or t
tcagtacgagtatgcacgaccggtgctcgatttagtacacacacttagggagttggggggggggtctcaggaggcagcgctctcgggacgtctccaccatggcctgggctctgctattcctccaccctcctcactcagggcacgagggtcctcgggcccaggtctgccctgacctcacgcctgcctccgtgtcgtggtctccgtggacagtcgatcaccatcctcctgaccacgtaggaaccngcgtagtgtacgttggtaggtactaacttagtcgtacctcgtacgtaaccacgtacgccaaccgagaccaaaccgacccccgtaaaactcgtaacttagtacttttaagtcgtaagttcgtacgtaacggttacgtcccgggtacccgttacgggttacggggttttaccttaacgtccgttccgttacgttcggttacggtaccctacggttagtccgttacggacaaaccgtccggtaccctccgacgtacctcgtcgtcggtaccggtacctacgggaccgtacgggtaccgggaaggtaccggtacgggtacgttaacgtaagtttttaccggtaacggttacgactcggtaaccttacgtaattacggttaaaaccgcgaaccggtacggaacccgtaccgtaccttaaaccggtcccgtttaaccgggttccgggttaaccggggaaccgtttaaccgggtaaaccgtaaacccgggtaccccgttaaccgggtaacccgtttaccgggtaacccgaccccgggtaaaccccggtacccccgtttaaaccccggacccccgttaaccgtaacccgg

SEQ ID NO: 199479 - DNA, 726 bp, Homo sapiens
  misc_feature: GYAE6OF02HAHSW.18.59.F04.1.454.CMB.1.raw
  modified_base (307)..(307): a, c, t, g, unknown or other
  misc_feature (307)..(307): n is a, c, g, or t
  modified_base (442)..(442): a, c, t, g, unknown or other
  misc_feature (442)..(442): n is a, c, g, or t
  modified_base (484)..(484): a, c, t, g, unknown or other
  misc_feature (484)..(484): n is a, c, g, or t
  modified_base (515)..(515): a, c, t, g, unknown or other
  misc_feature (515)..(515): n is a, c, g, or t
tcagtacgagtatgcacgaccggtgctcgatttagtacacacacttagggagttggggggggagaggagccccagccttgggattcccaagtgttttcattcagtgatcaggactgaacacagagactcaccatggagtttgggctgagctggtattttccttgctgacttaattttaaaaggtcgtcctagtgtgaggtgcagcgtggtggaggtcggtgggggaggtcgtttagggtaaacgggcccgggggggttcccttagacccttccccgtgtaccacgtcctctggtacttctactttanacggtaacggtcctaggatacggaacgtcgggtccgccgtacggccgtaccggaggggacgggcgtgggaggttgggtcggacgttaaactaaaaccgaaatggtaagtggtacggacaacgacggactacggcncgaccgaccggtaggaacgcaagtactacacctatctagaanagtatagtaaactaacgaaaagctaaccgtnttaaacgtctcgtaacgaaactaaagttaccggaaacgtccggtactaaagggaaaccgaaacccggtaagaacccgtaccgtaccggtaccggttaattacccgtttaatacccggtacccaaccgttccctaccgagttaaccgccttaacacctaacgtaacttccggtagtacgtccgacgttcgggaaccggtaccgaacggtacc

SEQ ID NO: 199480 - DNA, 743 bp, Homo sapiens
  misc_feature: GYAE6OF02JJA5D.18.59.F04.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
  modified_base (640)..(640): a, c, t, g, unknown or other
  misc_feature (640)..(640): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggccagtctcgccctgactcagcctgcctccgtgtcgtggtactccgtggacngtcgatcacntctcngcacgtcgaccngcagtcgacgttggtagttaactaacttntacgtcctaccgtggtaaccaacgtcgaccacccgtaaggaccgaaacccgacccccgtaaactcgtaactcgtaatttacgtacggtatacgtaccaacttacggcccggtacccttacggtacgggtttaacctacgttcgctttacgttaccgtcggactaccggtacgttacgtacgggaccaaaccgtccgggtccctaccggtacgtaaccctaagttccgttaccgtacgggtccctccgggtaacggtcgtacgggacggtaacgtcgggtacttaacggttagttaaccgtttacgtcggtaaaccgttaccgtcgtaacgtaactaacgtaacggaactaccgtaaccgaggtcccttaacgttcgttaacncggtttaccgtaccgttaacggtacggaaccgggttacgaacgttacccggtccgtacggtacgaccgacccggttaaccggacccgtacccttacccgtacg

SEQ ID NO: 199481 - DNA, 850 bp, Homo sapiens
  misc_feature: GYAE6OF02IG0JP.18.59.F04.1.454.CMB.1.raw
  modified_base (452)..(452): a, c, t, g, unknown or other
  misc_feature (452)..(452): n is a, c, g, or t
  modified_base (842)..(842): a, c, t, g, unknown or other
  misc_feature (842)..(842): n is a, c, g, or t
tcagtacgagtatgcacgaccggtgctcgatttagtacacacacttagggattggggagagagaccctcccctgggatcctcgggcccagtctgggctgacgcagccgccctcagtcgtctcggggccccagggcaggagggtcaccatctcctgcactgggacgcaccctaccaactagtccggggtcgggttatgactggtaactacttcggtaaccacgcacgtccttaccgagggaccacgacccccaaaacgttccctcgaactttcggttttaggacgaacctaaacgtaaccgttcccggccttccggtcgggtacccgttcgaaccgtagttcccttcgtacgtcctacccgtaagtcctaggccctactaccgcctccgtccgttccgcaacctccggacgttcggacctaccgtaggtcgacggttaaggcgtcgagtccgngtacctagtttaccgatccgttacgtactacgtatactaagttcggaccgtaggtcgttaggtttacggtacgtttgtttcggttaaccgttaggttaccgttcggtttaacgggaaacccctttaaagggttcccgttaaccctttaaccggtaacggtttaccaaacccggttaccggaaaccccgttaccccgtaaacccttcggtaccttaacgggtccccttttccgggtaaccccctttccccgttaacccgtttaaaccccgtcccgtttaacgtttaaccccggtcgttaaccggttacccgggtacgggtttacccggtacccgggttccgggtttaacccgaaccgggtccggttaccggtaaccaccggtgttacccgngtaaccgg

SEQ ID NO: 199482 - DNA, 713 bp, Homo sapiens
  misc_feature: GYAE6OF02F3CG7.18.59.F04.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
tcagtacgagtatgcacgaccggtgctcgatttagtacacacacttagggattgggggggggtctcaggaggcagcgctctcgggacgtctccacatggcctgggctctgctattcctcaccctcctcactcagggcacgagggtcctgggcccagtctcgccctgactcagcctgcctccgtgtctgggtcctccgtggacngtcgatccaccatcctcctgcacgtcggaaccngctagtggtacgttggtagttaataactgtcgtctccgtagtaaccaacgtacgccaaccgtaggaccaaaaccgaccccctaaaacgtcctaagttagttaactttagagttactacggtactaaaccgttacgtcccggtccttacggtacggggtttacctaacgttcccgtacttctacgtcgttacctaccgtaacgtcgtcgggaccaaccggtccggtcccttccggactaccgtacttccggtcgtcggtacctccggacgttcgtacggacggcggtaacggtcgttataacgtttacgtcgtcacgtacgtactacgattaacgaaccgtagaacccgacgtacgtaccttaccgcttagttacgtacgttaccggtacgacggtaccggtaacgtaccggaccctaccggttacggacccgtaccgaaccggtaacccgaacccggtaccctaacccgttacccgg

SEQ ID NO: 199483 - DNA, 766 bp, Homo sapiens
  misc_feature: GYAE6OF02HO8S1.18.59.F04.1.454.CMB.1.raw
  modified_base (411)..(411): a, c, t, g, unknown or other
  misc_feature (411)..(411): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagacacccaggacaaacgcccccaaaactcatagatttatgatgtacaactaatccggcctcgtaacgggtttactaactcgtacttctcgtaggcctacaagttctaggcaactaccggacctcccagtaccctatccgtcgtacgggtcctacccgaacggtcgtacggaacgggtaccgacggtacgttaacgaagtttacttacggttacnccgagtccttaccaaagttaactaaaccgaacgcctaaaccgataccctatacctactacgttcgttaccgttaacggaacgttacgggaacctaaggtaccgtaccgttaccgtacggtaaccgaccgtacccaacggaaccccaaacccgtacgtaccgttaccgtaacccgttcccgttaccgttccccccggtacctttaccccgtaacccgttaaaccgttacccgttaccgtttaaaccgggtctaaacccgggggttaacggtccccggtaacggggttaaacccgaacccgggggtttaacccggaccctaaagggtttaacccggagttacgacttaccgagtacg

SEQ ID NO: 199484 - DNA, 880 bp, Homo sapiens
  misc_feature: GYAE6OF02JU0N4.18.59.F04.1.454.CMB.1.raw
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtgttataactatgtctctggtaccaacacgccaccaggacaaacgacccccaaactccatacgtatttatggtatcgtacacttaacgtccggccgttacggtacggggtttacctaacgtccgttcctttcgtcgtcggtccgtacctaaggtcttcggacctaaccggacccggtccccgttcccgtccggtaaccctaccgttccgttccgggttccgggtaccgttaccggtacggtaccgtagggtaacccgggtacggtaaccgggttcgttaacgttagtttaaccgtttaccgtcgggttaactacggtaccctttagtaaacttaacgttaaacggaaccggtcctaaacccgtacgtaacccttacccttaaccgttcgttaccgtttccggtttaccggtttaacccgggtaaccggttacgggaaaccgtaacccgggttacccgtacccgtttaacgggtaccgttaccgtaaccccggtacccgttaacccgggaaccccttaacccggttacttacccgttacgtacccgtttacccgttcccccttaacccccggtaccctttaccccgtaccgttaacccttaaccccgtttaacgggtccgttaacgggcccggggtaaccggttccggccgggaaaactcccggggtaactacccgtttaaacgggctaccggtcgtaccgtaggcccgttaac

SEQ ID NO: 199485 - DNA, 874 bp, Homo sapiens
  misc_feature: GYAE6OF02IIMI5.18.59.F04.1.454.CMB.1.raw
  modified_base (141)..(141): a, c, t, g, unknown or other
  misc_feature (141)..(141): n is a, c, g, or t
  modified_base (149)..(149): a, c, t, g, unknown or other
  misc_feature (149)..(149): n is a, c, g, or t
tcagtacgagtatgcacgaccggtgctcgatttagtacacacacttagggattgggggggggtctcaggaggcagcgctcgtcgggacgtctccaccatggcctgggctctgctattcctccaccctcctcactcaggcanacggtccngggccagtctgccctgacgtcacgcctcgccttccgtgtcgtcgggtctcctggacagtcgatccaccactctcctgacacgtcggaccagctagtacgtcggttacggttagttaactaacttagtacgtccttcgtacggtaaccaacgacgtccaacccggaggaaccaaaccgaacccccaaataacctagtagttaacttttagacgtacgttcgtaacctaacgtaaccggtccggtaccccgttaagggttaacgggtttttacctaaccggttccgttccgtttccgtacggtacggtccccttaaaccgttaacggtccggttacggaacccgtaaccggtcccggtacccctttcccggactaaccgtacccgttcgttccggcggtaccgtcccgaaggtaccgtcgggtaacgggaccggacgggttccgttaacgttaacgttttactaaacccgtcggtaaccgtaaccgtactaaccggtaattaaaccgtaaacccgtaaccgtaaccaacccgtaaaccggttccccttaaggtaccctttaacttacccgggttaccgtttaccggtaacccgggttaaccggttaaacccgggtaacccgttaaaccggggttaaccccttaccccggggttaacctaccgggtaaacccgtaacccggttaaaccccggaaccccggttaaccccccgtaacccgttaaccccgg

SEQ ID NO: 199486 - DNA, 682 bp, Homo sapiens
  misc_feature: GYAE6OF02JKMRS.18.59.F04.1.454.CMB.1.raw
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (497)..(497): a, c, t, g, unknown or other
  misc_feature (497)..(497): n is a, c, g, or t
  modified_base (557)..(557): a, c, t, g, unknown or other
  misc_feature (557)..(557): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
  modified_base (662)..(662): a, c, t, g, unknown or other
  misc_feature (662)..(662): n is a, c, g, or t
tcagtacgagtatgcacgaccggtgctcgatttagtacacacacttagggattggggggggtcgtcgaggaggcgagcgctctcgggacgtcgtccaccatggcctgggctctgctatcctcaccctcctcactcagggcacgaggtcctcgggcccagtctgccctgactcagcctgcctccgtgtctgggtctccgtggaccagttcgaactccaccattccgtcctgaccacgttccgggaaaccagctagtcggtaccgtttgggtaggttaacttaacctagtacgttcgtaccttacggttaaccaaacgtacgaccacccgacggaacgaacgacccccaaaacctcaactgtaatttactagtntacgtccaagtnacgtccgtccctacgtcggggttactactcggtcttcgtctacggcctacgtacgtcgtcgactacgaccgcccgtacctcggacctacctgttcccgtcgggtccttaccgnggtccgtaaggacgggacgtagggaccttgtaacgtttaacgttcgtcgtatacgcctanaacttagtaaccgacaccgtaanaccgntaaccttcgtacgtacttcgtacgttaccggtaggaccgtttaaccgaagtccctacccggttacgtcgtagacccncggttaaccgccctaacccg

SEQ ID NO: 199487 - DNA, 623 bp, Homo sapiens
  misc_feature: GYAE6OF02GPWMG.18.59.F04.1.454.CMB.1.raw
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatctcctgcacgtgaaccngcagtgacgttggtgttataactatgtctctgtaccacngcaccaggcaacgccccaatcatgatttangatgtcactaatccggccctacgtacgggtttctaatcgtcttctcgtcggtcctcgaagtcgtggaccaacaccggcctcccgtagacctatcctcgtgggccttccgacggtctaggacgggacgtggcgttagtatttacttacgtgcctagtctacgtaattactaaccgtaacgaccaaccgagtacctaacttcgtaccttacgttacggttaccggttacggtaaaccggttacgggtaaccctaacgggttcccgtaaacccggttccggttaaccggttaccgaccggtaccccgtaaaccggtaaccccccg

SEQ ID NO: 199488 - DNA, 826 bp, Homo sapiens
  misc_feature: GYAE6OF02ISFRF.18.59.F04.1.454.CMB.1.raw
tcagtacgagtatgcacgaccggtgctcgatttagtacacacacttagggattgggggagctctgggagaggagccccagccttgggattcccaagtgttttcattcagtgatcaggactgaacacagaggactcaccatggagtttgggctgagcgtggtatttttccctgcttgtcttaatttttaaaaggtgttaccagttgtagaggtgctagcgtggtggagtcggtagggggtagtcggttagggtaaacgggtcccgggggggttacccttacggaccttccccgttagtacgacgtcccttcgtggtacttccttactttcgaacggttaacgggtcctggtaagttcgaaccggttcgggtccccggaccgtacgggtcccgttaccgggaagggggtaacggggggtccggtgggtacggggtttcgggggttcggtaacccgtttaaaacgttaaaaaaacccgtaaaagttcggtaaggtttcggggtaacgggaaaccaaacgtaacggtaaccgttacggaccgttcgacccgtaacccggtaaggaaaacggtccaggtactttaccgaaccttcgtaccgtacgaaataggtaacttaacggtaacttaaacgaaaaacgtcaacgtcgtacttagtctacgaacgtaaatacgacaacgtccgtaagaacggacgtaaacgactaccggaagtcccgttaagtaccgtttacaaccgtaccgtaaccctacgttacccgaagttaaacccgtgttaaccccaacgttactacccttagttaaccggtaacgttcccgaccgttaccggg

SEQ ID NO: 199489 - DNA, 691 bp, Homo sapiens
  misc_feature: GYAE6OF02HBJU2.18.59.F04.1.454.CMB.1.raw
  modified_base (314)..(314): a, c, t, g, unknown or other
  misc_feature (314)..(314): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctgccctgactcagcctgcctccgtgtctcgggtctcccgtggacagtcgatccaccatctcctgcactggaaccagcagtgacgttggtggttaataactatgtctccgtaggtaccaacagcaccaggacaaacgaccccaatcatgattangatgtactaactaacgtccggccctcgtaggggtttactaacgtcgtcgttactcgtcggcttaccaagttctggaccaacgtaccggcccttcccgtcgaacctattccgtaccgtggggaccctaccggtaaggtacgtacgggaaacggggaccggtacggtaccgttaacgtaaccgtttaacgttaccttacggacccttaacgttactaagtacgtaacgtacgtaggacgtcgtaggtaggttacggtttcgttacgttcggttacggttacggtagttacccggtacggggtaacccgtaacgggttcccgtaaccccgggttacttaaacgggtacccaaccgggtaccccgtaacgggtaacccccc

SEQ ID NO: 199490 - DNA, 679 bp, Homo sapiens
  misc_feature: GYAE6OF02GXJVC.18.59.F04.1.454.CMB.1.raw
  modified_base (278)..(278): a, c, t, g, unknown or other
  misc_feature (278)..(278): n is a, c, g, or t
tcagtacgagtatgcacgaccggtgctcgatttagtacacacacttagggattggggggggtctcgaggagcagcgctcgtcgggacgtctccaccatggcctgggctctgctattcctcaccctctcactcaggcacgaggtcctgggccagtctcgcctgactcgagtcctgcctcgtgtcgtggtcctccgtggactagtaccgactccaaccgtacttcctccgtcggacctacgtacgaaccagctagtcgtacggttggtacgttaatactntcgtctcgtacgtacacgacgaccacgacgaccgaaccgaccctaactacgtacgtacgtattagtagtacgtacgtactacgtacgtccgtaccgtacgttacgttactacgtcgtcgttcgtcgtcgtacgtacgtacgtcgtttacgaccgtaccgtaccgtaccctccgtacgtaccgtacgtccgtcgtcgtacgtacgtacgtcgtacgacgtacggtacgtacgtacgttacgttacgtacgtacgtacgtacgtactacgtacgtacgtacgtacgacgtacgtacgtacgtactacgtacgtacgtacgtacgtacgtaccggtacgtaccgtaccgtaccgtaccgtacgtaccgtaccgtacccgtacccgtaccgtaccgtacgtaccg

SEQ ID NO: 199491 - DNA, 832 bp, Homo sapiens
  misc_feature: GYAE6OF02FXS5B.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggccagtctgccctgactcacgcctcgtccgtcgtcgtcgtcggtcctcgtacgacgtacgtcgtactaccacctactccttccgtcgacctaacggtaccggaaccgacggtacgtacgggttacggttacgggttttgggttaactttaacgggggggggggggggttaacttagttcgttccgttccgttaccgtaaccaacgacgtacccgaaccgacgaaccgaacccgaaccccctaaccctactacgtagttaactttacgtacgtacgttacgtacctaacgtacggtacccggtacccgttacgggttacggtttacgttacgtccgttccgttctcgtcgtccgtaccgtacgttcggtacggtaacgtaccgtacccggtacccgttcccgtaccgtacctcctacgttccggtccggtccgtaccggtcggtcggtacgggtaaccgggacggtacggtacgttacgttaacgtttacttacgtcgtacgtacggtacctacgtaacttaacgtaacgtacgaacgacgtaacgacgtaccgtacgtaaccgttacggttaccggtaccggttaacgggtaaccggtaaccggtaacccgtaccggttacccggtaccggttaccggtaccgaacccggtacccgaacccgtaaccccgttaaccccgg

SEQ ID NO: 199492 - DNA, 677 bp, Homo sapiens
  misc_feature: GYAE6OF02F5AG7.18.59.F04.1.454.CMB.1.raw
  modified_base (130)..(130): a, c, t, g, unknown or other
  misc_feature (130)..(130): n is a, c, g, or t
  modified_base (577)..(577): a, c, t, g, unknown or other
  misc_feature (577)..(577): n is a, c, g, or t
  modified_base (663)..(663): a, c, t, g, unknown or other
  misc_feature (663)..(663): n is a, c, g, or t
tcagtacgagtatgcacgaccggtgctcgatttagtacacacacttagggattgggggggggtctcaggaggcagcgctctcgggacgtctccaccatggccgtgggctctgctacttcctcaccctccncactcagggcacgacgggtcgtcgggcctagtctcgccctgacgtcacgcctcgcctccgtagtcgttcgggtcctcgtaggaactcggtacgactaccacctacttccgtctcgactccgtacggaccacggctaacgtggtacggttggtaggttactacgtagtcgtctacgtacgtaccaacacgaccgacgacgaaccgaaaccgtaccctaactcacttacgttagttacgtagtactacgtactaacttcgtccgtaccgttacgggttacgttactacgtctaccttcgtaccggtacgtacctacgacgtcggtaacgacgtaacgtccgtccgtaccgtcgtacctacgttccggtcgtccgtccgtaccggaggtcaacgggtacgacggttactcgttagtaacttcgtacgagtcacgtctagtacagactacnctacgacactaacgtcgtaacgttcgtacgtacgacggtaccgaacgtccgtacgtacgtacgaccgacgtaaccgccggtaaccnccggttactacgcc

SEQ ID NO: 199493 - DNA, 851 bp, Homo sapiens
  misc_feature: GYAE6OF02IEHS4.18.59.F04.1.454.CMB.1.raw
  modified_base (813)..(813): a, c, t, g, unknown or other
  misc_feature (813)..(813): n is a, c, g, or t
tcagtacgagtatgcacgaccggtgctcgatttagtacacacacttagggattgggggctttgccgtgggtcctgggcccagtctgccctgactcagcctgcctccgtgtcgtgggtctcctggacagtcgatccacatctcctgcactggaaccagcagtgacgttggtaggttataacttatgtaccttcctggtaaccaacacgccaccgaggacaaacgcccccaaactcaatgtattatgtactcgtactaactacgtccggtccctaggttacgggtttacttaatccgttcctttaccttcgtacggtacctacgtaacgtcgttacggaccaaccgtaccgggtccccttcccgtacgtaaccctacttaccgtccggtacggccgttaccgacggtcgtcggaaccgggacgtacggtcgttacgttaactttacgtttaccgtacgacgtacgtcctactaacgttaaacgaaccggtaacacccgtaaccgtacctaccgtttacccttaccttacgttacggtttaccgttaccggttaaccggtaacgggttacggtaacccgtaacgggtccccgtaccggttaaccgtaccggaacctaacccggtaccgtaacccgtaccccgtaacctacgtccgttaccctacccgttcccgttacccggttcccccttacccgttaccccggtaccttttaacccggttacccgttaacccgggttagtttacccggggaaccggggttcccgggtaacgggtttaccccgggaacggggttaacccccgacggtttaaacccncgggtttaaccggacgtcttaaccggcgttccgaaccg

SEQ ID NO: 199494 - DNA, 723 bp, Homo sapiens
  misc_feature: GYAE6OF02FZI9T.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggtcgttagggtaaaggcccgggggggttacccttaggacctcccctggtaccgacgcctcgtggtattcctacttttcaggtaacggccgtaggatcgaacgtcgggtacccgccgagggcctccggaagggggaacggggtcgtgggtaggttcgggggttaggtacccgttaaagtttaaaaaacccgaaaacgttggtaacgtagggtacgggaacaacgaagaacgtaccgcgtacgacgaacccggtagaaacggctacgtacttaccaccactacgtacgaagacgtatagtaactaacgaaaacgtccaacgtcgtagttacttctacgtaaacgaaatacgaactacggacctagggaaaccgaaccggagaaccgaacgtacgtaccgttaagttaaccgttactacgtacccacgtaccgtacccgtaggtaaccgtacctacgtaaacctacgtaaccttaccgttaacgtgtaccggtacctaccggg

SEQ ID NO: 199495 - DNA, 900 bp, Homo sapiens
  misc_feature: GYAE6OF02HWA45.18.59.F04.1.454.CMB.1.raw
  modified_base (236)..(236): a, c, t, g, unknown or other
  misc_feature (236)..(236): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcaggcacgagggtcctgggcccagtctgccctgacctcaacctcgcctcgtgtcgtgggtctccgtggacagtcgatcaccatcctcctgcacgtcggaaccngctagtcgtacgttggtacgttaataactgtcgtcttccgtacggtaaccaacgtacgtaccacccggaacggaaccctaaaacccggacccccctaaaacgttcctaacgttacgttaaacgtttttaacgtaggtacgttacgttaacctaaccttaaaccgggtaccccgtacccgtttaagggttaaccggggttttaacctaaaccgtccggtttcctttccgtaccgtccggggttaacccttaccgtaaacgggttccgtttacggaacccgtaaaccggtaacccgggtccccttacccgttaaccgtaccccgttaacgttcccgtttccgggttaaccgggtcccgttacccggtacgggtacgtacggggtaaccgggtacggacggtacgttacgttaactttaacgttacgttcgaaccgtacgtacttacaacttaacaaaccggaacgtcccgaaaccgtacgtacccttaaccgttccgttaaacgttccgtttacggttacccgtttaccggggtaaaccggtttaacccgggaaacccggttaacccggttaacccgttccccggtttaaaccggtaccggtaacccggtacccggaaaccccggtaacccgggtaaccccccttaaccccgtacgtttaacccgg

SEQ ID NO: 199496 - DNA, 705 bp, Homo sapiens
  misc_feature: GYAE6OF02JA4VG.18.59.F04.1.454.CMB.1.raw
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctcgccctgactcagcctgcctcgtgtctggtctcgtggacngtcatcacatctctgacncgtcggaaccngctaggtgtacggtttggtagttaactaacttattcgtccttaccgtacggtaaccaaacgtacaccgaacccgtaacgggaacaaaccccggtaacccccaaacgttcaattacggttaatttaagtagacgttgtacctaacgttaacgtcccgccgttacggtacgggttttactaacgtcgtctttcgtacgtcgtccttaccgagttcgtacgaccgtaaccgtacccggtcccttaccgtacgtacctacttccgtacggtcggtccgtaacgtggtacgttacgggacggtacggtagttacgtacggttaactttaacgtcgttacgtacggacctacgtacgtataacgttaacaccggacaaccgtactaccgtctacgtctagttccgtacgttacgaacggttcgaaccggttacgtacccgtaccgtgtaacggccgtaccgaacccgtacgacccttcaccg

SEQ ID NO: 199497 - DNA, 692 bp, Homo sapiens
  misc_feature: GYAE6OF02FNFE7.18.59.F04.1.454.CMB.1.raw
  modified_base (219)..(219): a, c, t, g, unknown or other
  misc_feature (219)..(219): n is a, c, g, or t
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (561)..(561): a, c, t, g, unknown or other
  misc_feature (561)..(561): n is a, c, g, or t
tcagtacgagtatgcacgaccggtgctcgatttagtacacacacttagggattgggggggggtctcaggaggcagcgctctcgggacgtctccaccatggcctggctctgctattcctcaccctcctcactcgaggcacgaggtcctgggcccagtctgcccctgctcagccttgcctccgtgtctagggtccttcctggactgtcgatcgaccatccncctcggcactggacccagcagtgtaccgttggtcggttataactagtntctcctggttaccactagccaccgaggacgaaaccnccccccaaaactcgaatcgtaatttaatcggtaatcggtacacgtaaatccgggtacccttaccgagggggttttcttaaactcggttacctttccgtcgtcggtactaccgttaaacggtcgtacgggtacaccgaaccgggtcccttacccgtcgtaccctaagtcgtaccgttcgggtacttcccgacggaccgttggacggacggaacggactagggactttacttacgtcgacgtacgactccaaatacctanaaacggacccaaccctaagcgaaccttcgtacttagtacggtttcgttcgaacccggttcgggaacctaacgggtcctaccgggtacctaccgggactaccgacccaaccgggtacccaaccccgtacccg

SEQ ID NO: 199498 - DNA, 809 bp, Homo sapiens
  misc_feature: GYAE6OF02JNDS0.18.59.F04.1.454.CMB.1.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcgagggccacgagggtccgtcgggcccagtcctcgcccgtgacctcacgcctcgcctccgtgtcgtcgggtctccgtggacagtcgactcaccntcctcctgctacgtacgaaccngtcgagtcgtacggttggtagttaactacgtatcgtcgtccgtacggtaaccaacgacgcctaacccgaggaccgaaacccgtacccccgtaaactacagttaacgtatttaacgtacgtagtaccgtaacctaacgttaactcccggtaccgttaaccggtacgggttttacctaagtcccgttcttctcgtcgtcctacgtaacgtcgtcggtaaccaccgtacccgtcccgtaccgtacgtactccgtacttccggtacgggacctaccggacggtaccgtacgggaacggtacgggtccgtacgtagttaacttaacgggttaccttcggacgttaccgtaacgtacgtaacgtaaccgttaacggtaaccgtacccgtaaacctacggtaaccctacgtttaaccgtaaccttttacggtaccgtttaccgggtacccggtaaaccgggttccgggtaaaccgtaccgggtaccccggttaacccgttaaccggttacccggtaacccgtacccggtaaccccgggaaccccgttaccccgtaccccgtaacccggg

SEQ ID NO: 199499 - DNA, 781 bp, Homo sapiens
  misc_feature: GYAE6OF02I1DXS.18.59.F04.1.454.CMB.1.raw
  modified_base (667)..(667): a, c, t, g, unknown or other
  misc_feature (667)..(667): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagcgtggattttccttgctgcttagtttaaaggtgtccagtgtgaggtgcagcgtgggtggaggtcgtgggggaggtcgttagggtaaacgggcccgggggggtcccttaggacccgtccccgtagtacacgtcctcgtggacttcctaccgtttcgaggtaacggtcctaggtactaggtaacgtcggggtcccgaccgacggtcccgtaccggaagggggacggggtccgtagggtacgggttggggttcgggtacccggttaaaagttaaaaacccgaaaacgtggtaacggtaggggttacgggaactaaacgtaacggaaccgtaacgccgttacgacccgtaacccggtaaggtaaacgggcgaacgtaacgttaccaaccgtacgttcgaacgaaaggtacgaacgttgaaacgttaacaaaaacggtccgaagtaccgtattacgtcgtaacgtaactaaagtacggaactaccggtacgtaacgaaacgggtaaccgacggaaacnccggtaaaccgtacgttagttaaccgttacgtaccggtacccacgtaacccgtccgaaaggtaccgtacgttacaaccttacggtacctaaggtactacggtacgtcctacggg

SEQ ID NO: 199500 - DNA, 837 bp, Homo sapiens
  misc_feature: GYAE6OF02FK59J.18.59.F04.1.454.CMB.1.raw
tcagtacgagtatgcacgaccggtgctcgatttagtacacacacttagggattggggggggtctcaggaggcagcgctctcggacgtctccacatggcctgggctctgctattcctcaccctctcactcagggcacgagggtcctgggccagttcagccctgactcagcctcgacctccgtgtctgggtctccgtgacagtcgatcacgatcgtcctgcacgtcggaaccagcaggtcgacgtttggtagttataactattcggtctccgtaggtaacctaacgacgtcacccgaaggtaccaaacggtccccaaattcgaacgttcgtatttacgtacgtagttacgtaccgtaacgtaacggtcccggtaccgttacggttacggggtttacttaacgtccgttcgttaccgttacgttcgggtaccttacccgtaaacgtttccgacggtaaccaaacggtacccggtttccgtacccgttacgtaccgtactaccgttttcggacccggtcgtacccgttacggaccgtacggtaaccggacggtaaggtccgttacggtacgtttaacgttaccggtagtacgaaccggtacctttacgggtaaacttacggttaaaccaaccggtccctaaacccggttaccgaaccgggttaacccttacccggttaagttaaacccgtttcgggtttacccgttaaccggtaacggtttaaacccggggaaccggttacccggttacccgttaaaccccggggttaccttttaacccgggacccgtttaaacccgggttaaccctaaacccggggaccccttttaaaccccggtaccgg

SEQ ID NO: 199501 - DNA, 705 bp, Homo sapiens
  misc_feature: GYAE6OF02FNJ5H.18.59.F04.1.454.CMB.1.raw
  modified_base (698)..(698): a, c, t, g, unknown or other
  misc_feature (698)..(698): n is a, c, g, or t
  modified_base (705)..(705): a, c, t, g, unknown or other
  misc_feature (705)..(705): n is a, c, g, or t
tcagtacgagtatgcacgaccggtgctcgatttagtacacacacttagggattgggggctttgcctgggtcctgggcccagtctgccctgactcagcctgcctccgtgtctggggtctcctggacagtcgatcaccatctcctgcactggaaccagcagtgacgttggtggttataactatgtctcctggtaccaacagcacccaggccaaacgcccccaaatcatgatttatgatgtcactaatcggcctgtagggtttcaatcgcttctctggctccgaagttctggcaaccacggcccttccgtgaccattcctcgtagggcctccgaggtcctgggaacggacggaacggtcttagtaattttacttaagtcgtacacgtactacgaatactaacgaacgcaaccgacgtctaaccttcgtacttacgtcgtttccggttacggaacgttacgggaaccgtaacggtccgtacccgtaccgtacgggttccaaccggacccgtaaccggacccctaacccccgtagtaccggttaccctaccggtttacccttacccggtttaccccccaccccgtttttacccctacccgtaaaccctttcccgttaacccgtttaccgcgggtaaccgggtcccggggttacctaccggggtacccgtaaacgggttcccgaaccgtacggttaacggcctnctcgctn

SEQ ID NO: 199502 - DNA, 798 bp, Homo sapiens
  misc_feature: GYAE6OF02HAUCN.18.59.F04.1.454.CMB.1.raw
  modified_base (236)..(236): a, c, t, g, unknown or other
  misc_feature (236)..(236): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggactagtcgatcaccatcctcctgacactcggaaccngctagtgtacggttggtacggttaataacgtatcgttcttccgtacggtaaccaacgtacgccaaccccgaggaacccgaaaaccggaccccccctaaaaactccgtaaagttcggtaaattttaacgtacggttaacgttacggttaaccgtaaacgttaaccggttcccggttccccgttaaccggtttacgggggttttaccttaacgttcccggttcgttaccttcgtcgggtaccctacgtaacgtccggttaggaccctaacggtaacccgtccgtacccgtcgtaaccctacgtccgtcggtcggtaccgtaccgtacggtacgacgggtaacggaccggtacgtaccgttagttaccgtttaactcggtacgtacctacgtaccgtactacttaaggaaccaagtcgtaaccgacgaactacccgtaacgtaaccgtacgttaccgttaaccgggtaacggttcccgggaaacgtaccggttacccttaacccgggtaacccgttacggaacccgtaaccggtaacccccggtaccgtaacccccgtaaacccg

SEQ ID NO: 199503 - DNA, 813 bp, Homo sapiens
  misc_feature: GYAE6OF02FGZGD.18.59.F04.1.454.CMB.1.raw
  modified_base (184)..(184): a, c, t, g, unknown or other
  misc_feature (184)..(184): n is a, c, g, or t
tcagtacgagtatgcacgaccggtgctcgatttagtacacacacttagggattggggagctctgggagaggagccccagccttgggattcccaagtgttttcattcagtgatcaggctgacacagaggactcaccatggagtttgggctgagtctggtactttcctgctgtactatttaaaggngtccagtgtgaggtgcgagtcgtggtggacgtcgtgggggacgtcgttaggtaacgggtcccggggggttcctacgacctcccgtgtacacggtcctacgtcggtactacctactttcgacggtaacggtccgtaggacgtacggtaacggttcgggtaccccgtccgtaacgggtccgttaccggaaggggtaacggggtcttacgggtagggtccggggtttacggacccgttaaaacgttaaaaaccgaaacgttcggtaaggtagggtacggtaaaccgtaacggtacgtaaccgtacgtcgtaccgacccgtaccggtagaaacggtactacgtactaccacctacgtacgaccgtaagagtcctaagtacccttaaacaaaacgtcccgtaacgtcacggttactaccgtagtaacgtaaactacgtaccgtaccgggaacttaaccgggaaacggtaaacccggtacggaacctaaccgggttacggtaccctttaagggttaacctaccgtttacgacccaaccgttccgttaaacccggataaacccgggtccctaaacgtaaccgttaaccgttaacccgttaacggttacggtaccgttaccggtaacccgtacgggg

SEQ ID NO: 199504 - DNA, 707 bp, Homo sapiens
  misc_feature: GYAE6OF02H2RK8.18.59.F04.1.454.CMB.1.raw
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (245)..(245): a, c, t, g, unknown or other
  misc_feature (245)..(245): n is a, c, g, or t
  modified_base (580)..(580): a, c, t, g, unknown or other
  misc_feature (580)..(580): n is a, c, g, or t
tcagtacgagtatgcacgaccggtgctcgatttagtacacacacttagggagttgggggctggggtctcaggaggcagcgctcgtcggacgtctccaccatcggcctgggctctgctattcctcaccctctctatcgaggccacgacggtcctcgggcccagtcctcgccctgactcacgcctgcctcggtgtctcggtctccgtggccagtcatcgactagttccncgtancctacgcggaacngactgtagtacggttggtacttaactaactatcgtcctacgtcgtaacgaactacggccaccgtacgacgaaaccaccccaactacagtagtacttagctagtacgtacaacttagtcccgtcctacggttacgggttacaacgttctccgtattccgtcgactacgtacgttaccgtaggaacctaacgtccggtccctcccgtaacggacctacgttacccggtttcgcggtaccgtacccgtaggcgttcgggacggtagtacggttactaggtttaattaacgttacgacggtcctaacgtaccgtactaaaacgtttacaaccggtaaancccgttaaaaccagtacccgtaaccttacttacgtacgttaccggttaccggtaacgaacggtttacggaaccgttaccgtaacgttcccggtaacgtcgttacgaaacccgccgtaaccgaacccc

SEQ ID NO: 199505 - DNA, 666 bp, Homo sapiens
  misc_feature: GYAE6OF02HEON9.18.59.F04.1.454.CMB.1.raw
  modified_base (622)..(622): a, c, t, g, unknown or other
  misc_feature (622)..(622): n is a, c, g, or t
  modified_base (635)..(635): a, c, t, g, unknown or other
  misc_feature (635)..(635): n is a, c, g, or t
  modified_base (644)..(644): a, c, t, g, unknown or other
  misc_feature (644)..(644): n is a, c, g, or t
  modified_base (648)..(650): a, c, t, g, unknown or other
  misc_feature (648)..(650): n is a, c, g, or t
  modified_base (652)..(652): a, c, t, g, unknown or other
  misc_feature (652)..(652): n is a, c, g, or t
  modified_base (654)..(654): a, c, t, g, unknown or other
  misc_feature (654)..(654): n is a, c, g, or t
  modified_base (659)..(661): a, c, t, g, unknown or other
  misc_feature (659)..(661): n is a, c, g, or t
  modified_base (664)..(666): a, c, t, g, unknown or other
  misc_feature (664)..(666): n is a, c, g, or t
tcagtacgagtatgcacgaccggtgctcgatttagtacacacacttagggattgggggctttgtctgggtctcctggacagtcgatcaccatctcctgcactggaaccagcagtgacggttggtggttataactatgtctcctggtaaccacagccacccaggcaaacgcccccaaactcatgtatttagtgattgtaccactaacgtccggcccttggtacgggtttactagtccgtcttcgtcgtcggtacctcctaaggtctgggtaccaaccgaccggtcccttcccgtacgaacctacttccttcggtcgggtccctaccgaggtcgtacggtaacgggacggtagggtccgtaggttaactttaacgttaaccgttcgacgacggttacctataaacttaacgtaaaccaacgacccaaccacggtacctactacctactacgttcgttaccgttacgtaacgtacgggtaaccgaacgtccgtaccgtccgtacgaccgtaccgaccgacccgtacccaacccgtcctacgtcgtacctaccgtcccgttacccctaccctacctacctacctccgtacgtacgtacgaccggcgtcggcgaacgacgcgcgtancgacgatcagtcntacgactcncgannntncncgtcnnnctnnn

SEQ ID NO: 199506 - DNA, 696 bp, Homo sapiens
  misc_feature: GYAE6OF02F7WAH.18.59.F04.1.454.CMB.1.raw
  modified_base (211)..(211): a, c, t, g, unknown or other
  misc_feature (211)..(211): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcgagggcacagggtcctggccagtctgccctgactcagcctgcctccgtgtctgggtcctcctggacagtcgatcacntctacctgctactggaaccgcagtgtacgttggtgttaatacgtatgtctcctacggtaccaacgacgtccaccgagtacaaaccgacccccaaactccagttacgtatttacgagtactcgtactaacgtaactccggtcccgttcggtacgggtttactaacgtccgtcttacgtcctcggtcctacgtacgttcgtacggtacgaacgtacccgtcctacccgtacgtaaccctcgtccgttcgtaccggtcctaccggaggtccgtaggacgggacggagttacgtacggttatttaaccgttacgttacgccggacttccgtactaaacttaccgaacgaacgtcccaacggtactacccttctaccttacgtacgttacgttcccgttacggtaaccggtccgggtaaccttaccggtaccgtaccggttacgtacggaccctaccgggtacccgaaccgtaccccgaacccttcccgg

SEQ ID NO: 199507 - DNA, 872 bp, Homo sapiens
  misc_feature: GYAE6OF02ITWPU.18.59.F04.1.454.CMB.1.raw
  modified_base (236)..(236): a, c, t, g, unknown or other
  misc_feature (236)..(236): n is a, c, g, or t
tcagtacgagtatgcacgaccggtgctcgatttagtacacacacttagggagttgggggggggtctcaggaggcagcgctcgtcgggacgtctccacatggcctgggctctgctattcctcaccctcctcactcagggcacgtacggtccgtcgggcccagtccgtcgcccgtacgactcacgcctgcccgtccgtgtcgttcggtcctccgtaggactaggtcgtacaccaaccncttcctccgtcgacctacgtacgggaacctagaccgtagtacggttcggtttagggttaagtttaactaacgttacgttcgttccgtaccgttaccgggtaaacccgtaaacaccggaaccccgtaaccggacggtaaaccccgaaaaccccgaaccccccgtaaactacgacgttagttaacgttttaacgtcggttaacttacgtaaccgtaacgttaaccggtccccgtacccggtttaacggttaacggggtttacgttaaccgttccgttaccgttccgttaccgtaccggtccgtaccgtaacggtttcccgaaggtaacccgtccgacccgttccctcccgtagacccttacgtccgtcggccgttaccgtcgaccggtacggtaccggacggtacgggtcacggttaacttacgtttaacgtaccggttacggaacgttccgacctttaacgaacgttaaaccgtacgaaacccggtcgaaacgttaccgaaccgttacccgtaaagtaacccggttaacggttaacccgggttacggacccgttaacgggtacccggaaccgttaccgtacccggtttagaaccgccggttaacccgaaccgaacccgtacccacggtttccaaccg

SEQ ID NO: 199508 - DNA, 969 bp, Homo sapiens
  misc_feature: GYAE6OF02FYB9Z.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggtattttccttgctgacttaattttaaaaggtgtccagtgtgaggtgcagtcgtggtggagttcggtaggggggtaggtcgttagggtaaacgggccccggggggggttacccttaacggtacccgttcccccgttaggttaaccgacggtcccttaccgtggtacttccgtacttttcgaacgggttaacggtccctggacttacggtaaccggtcgggttaccccggccgtagggtacccgttacccggaaggggggtaacgggggcgttaggggtacgggttcggggttacgggaacccggtttaaaacttaaaaaaccccgtaaaaagtcgggtaaggttacggggttacggggaaacctaaaacgtacggtaaccgtaaccggtccttaccgggaccccgtaacccgggttaacggaaaacgggtaccgtaaacggtaacctttaaccgaaccccgtaacgtttacccgtaacgtaaaccgtaggttaacttacggtaaaacgtttaaaccgaaaaacggttccaaaccgggttacttaaggttacctacggtaacgttaaacggaacttacgaacgtaacgtaccgtaacggtaaacgggaacccggaagaccccgtagttaccgggtacccgtttaacgttaaacgtttacccgttacgtaaccccgtacttaccccgtaccccgttaaagggtaacccgttaccctttaaccgttaaacccttaaccgtttaaaccggttacccggttaacgggtttaacccggtaaccggtacccccggttacgggtaaccggggtaacccccggg

SEQ ID NO: 199509 - DNA, 695 bp, Homo sapiens
  misc_feature: GYAE6OF02FXQR6.18.59.F04.1.454.CMB.1.raw
  modified_base (171)..(171): a, c, t, g, unknown or other
  misc_feature (171)..(171): n is a, c, g, or t
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactnagcctgccctcgtgtctggtctccgtggacagtcgatccacatcctcngctactggaaccngcaggtgtacggttggtagttaataactagtgtctcctggttaccaacagcctaccaggccaaacgccccctaaacgtcatgtaattatgtatcgtccaacgtaactcccggtccctcggtacgggtttactaacgtccgtcctttcgtctacggtccgtaccgtagttcgtacggacctaaacgcccggtaccctcccgtaccgaccgttacctcgtttcccggtgggttccctaccgtacgggcgttaacgggtacggaaccggtacggtcgtagttacgtttaacgttacctcggaccttaccgcttacgtaacttacgaaccttaacggacctaacgaccgtaccgacttacccgtacttacgttacgttcccggttaacgggtaacgttacccgggtaacgaaccggtcccgttacccgttaccgtacggtaccgaccgacccggaccgtaacccccg

SEQ ID NO: 199510 - DNA, 730 bp, Homo sapiens
  misc_feature: GYAE6OF02GJBXM.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctccaccctcctcactcagggcacgagggtcctgggcccagtctcgccctgacctcagcctgcctccgtgtcgtgggtcctccgtggacagtcgatcacctatctcctgccactacggaaccagcagttgtacggttggttaggttaacttacgttagttcgttccttacccgttacggtaaccaaaccgacgtaccaccccgaaggtaccaaaacccgaccccccaaacgtacaacttagtactttatagtattacgtacctaacgtaacgtccggtaccctacgggttaccggtttacttaacgtccgttacgttcctcggtacgtccttaccgtacgttaccggtcggtaaccgaacccgtacccgttacccctccgtacgtaaccctacgtacccgtttacggtaccggtcctaccgccggttacgacgggtaacggacggaggtccgttagttaacgtttacgttacgtcgtacgactcgttaacaactaagtaccgaaccgccacccgagtcctaccgttctacgttacttggtaccgttcgtacggtaacggtacgtaccgaccgtccgtacgtaccggacaccgtacccgcgtacccaccgtacg

SEQ ID NO: 199511 - DNA, 808 bp, Homo sapiens
  misc_feature: GYAE6OF02H0I6F.18.59.F04.1.454.CMB.1.raw
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (281)..(281): a, c, t, g, unknown or other
  misc_feature (281)..(281): n is a, c, g, or t
tcagtacgagtatgcacgaccggtgctcgatttagtacacacacttagggagttgggggggggtctcaggaggcagcgctctcgggacgtcctccaccatggcctgggctctgctattcctcaccctctcactcgagggcacgacgggtcctggggcccaggtctcgccctgacctcacgctgccctccgngtcgtgggtcctcgtggacngtcgatcactactcctcctgccacgtacggaaccanccgaagtggtacggtttgggtagtttactaactnttcggttccttccgttacggtaaccacgtacgaccgaaccccgaggaaccaaacccgtaccccccaaagttccgatagtttacttagtagtagtcgtacgtaactaacgtcccgttaccgtacggttacggttactaaccgttccgtaccttcgttcgtccggtactacggttacgtacgttacgaaccaacccggtacccggtccctacccgtacgtaacctacgttcccgtacggtccgggtaccctccgggttaacggcggttacgggaaacggacgggtaccggttacttaaggtttaaactttacggttaccgttacgaacgttaccggtaacctaccgttaaacgttccgtaaaaccggtaacctaacccgaacgtacccgttaaccctccggttaaaccttacgtacgttaccgtttaccgggacgtaacccgggtaaccgtaacccggttacggacccgtttaacccggacgggttacacctaacccggacgaccccggtaacccctaacccgttaccg

SEQ ID NO: 199512 - DNA, 830 bp, Homo sapiens
  misc_feature: GYAE6OF02H3XNH.18.59.F04.1.454.CMB.1.raw
  modified_base (205)..(205): a, c, t, g, unknown or other
  misc_feature (205)..(205): n is a, c, g, or t
tcagtacgagtatgcacgaccggtgctcgatttagtacacacacttagggattggggtctgggagaggacgccccagccttgggattcccaagtgttttcattcagtgatcaggactgaacacagaggactcaccatggtagtttgggctgagcctggtacttttccttgtcgtgtacttaagttttaaaggtcgtccaggttgngtaggtgcgagtccgtggtgggacgggtcggggtaggcgttcggtccgaggtccggtcggggggtacctacggaaaccttcgccttggtacgcgtagtccttccggttcgggttacctaccgtcgtgtcggtactctcgtctagtcgtacgtacggtcggccctacgtacggtccggtacgggtaacggtcggtacggtggtcggggttcggtaccgtaaggtagtaacgtaacgaaacgttcgaaacgttacgtacggtacacggaacgtcgtaaaacgtgttacgaccgttacggaccggtacggtaagggaacccggtgttaccggtaccgtaacccgttaccggtactaaaaccgggtagttacgggtaaaccttaaaccgaaacggtaaaccggtcggttaacccggttaacgttaccgtaaggtaaaccgtaacgtaaacgttaccggaaccgttaaccggtaaacccgaaaccgggtacggtaacccggtaccgtaccggttacttaacgttaacgtaacgttacgaacgtaacgttcggaaccgtttgttaacgggttacggttagggtaggtaacccggttaccgggtaacgggtaacgggtaccgtaaagtcggg

SEQ ID NO: 199513 - DNA, 739 bp, Homo sapiens
  misc_feature: GYAE6OF02HOTH2.18.59.F04.1.454.CMB.1.raw
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (316)..(316): a, c, t, g, unknown or other
  misc_feature (316)..(316): n is a, c, g, or t
  modified_base (543)..(543): a, c, t, g, unknown or other
  misc_feature (543)..(543): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcaggcacagggtcctgggcccagtctcgccctgactcagcctgcctccgtgtctgggtcctccgtggacagtcatcaccatcctcctgcacgtcggaaccngcagtgtacgttggtagttataactntgtctcctggtaccacagccaccaggaccaaaccgaccccaaacgtcatgtatttangactgtaccacttaacgtccggcccttagtacggggtttacctaacgttccgtcttcgtcgtggtccctacgtaacggttcgtacggtaccaaacggtacccggtcccttaccccgttagaacccctacttccgttccggttcggggccctaccggacgggttccgtagggtacgggaacggtacgggtcttaggtaactttaacgttacgtcgacctacgccttanaagtttaccaaacgtaaaccgccctaaaccgacgtacccttaccgttaccgttaactttacttcggtttaccgttaccggggtaaacccgtttggggaaaccccggtttaacggtacccgtaccccgggttaacgttaccggggtaaccacccgggtaacccccggtaaaccgggaccccctaaaccccgtaccgg

SEQ ID NO: 199514 - DNA, 770 bp, Homo sapiens
  misc_feature: GYAE6OF02F2UKD.18.59.F04.1.454.CMB.1.raw
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtcctgccctgactcagcctgcctccgtgtcgtgggtcctcgtggctagtcgatcacnctctcctgcacgtcggaaccngctaggtgtcgtttggtagtttataactattcgtactccgtacggtaccaacgacgtccaccgagaccaaaccgccccctaaacgtctaagtacgttacttacgtacgattcgtacgtaacctacgtcccggtcccttagggtaacgggttttacctaacgttccggtacctttccggtcgttaccggtacgtaaccgttaacggttccgacggtaaacccaacccgtaccggtccccttaacccgcgttaacccgtacgttcccgttacgggtcccgggtacctacggacgggttacggtacggggtaaacgggtaccggtacggtaacgttacgttaaagtttaacccgtgttaaccggaccgtacgtacccgttaataacgtaaccgtaaccgtaacgaccctaacgtcgtaacctacgtaccgttctagttaccgttcgtaaccgggtacggtacgtaaccggttacggtacccgcccggtttaacgtacgtaccggaaccacccggtaacccgtacccgtaacgtacccgg

SEQ ID NO: 199515 - DNA, 756 bp, Homo sapiens
  misc_feature: GYAE6OF02GINZN.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatcctcctgcactggaaccagcagtgacgttggtggttaataacgtattgtctccgtacggtaccaaacgagaccacccgaggaccaaacggtccccccaaaacgtccaataggtaacttttatagacttggtacctaacttaacggtcccggaccccttacggtacggggttttactaactccggtacctttcgtccgttacggtcccttaccgtaaacgtttcccgtacgggtaacccaaaccggtacccggtccccgttaccccgtaccgtaaccctacgttacccttcggtacggggtaccccttaccggaccgggtacgtacggaacgggtaccggacgggtactacggttaacttttacgtacgttcgctaaggtcctacgtaacgtactaacgacgaccaaccgacgaccttaaccttccttaacgtaccttcgttaccgttacgggtaacccggtcgggtaacccgtaacggttaccctacccgggttacctacggtccgtaaccgaccccgtaacccggacccctaaccccgtaaccg

SEQ ID NO: 199516 - DNA, 968 bp, Homo sapiens
  misc_feature: GYAE6OF02GWRE2.18.59.F04.1.454.CMB.1.raw
  modified_base (354)..(354): a, c, t, g, unknown or other
  misc_feature (354)..(354): n is a, c, g, or t
tcagtacgagtatgcacgaccggtgctcgatttagtacacacacttagggagttgggggctttgcctggtcctgggcccagtctgccctgactcagcctgcctccgtgtctgggtctcctggacagtcgatcaccatctcctgcactggaaccagcagtgtacgttggtaggttataactatgtctcctggtaccaacgagccacccaggacaaacgacccccaaactcaactgtatttagtgtagtcgtacagttaaccgtccggacccgttacggtacgggtttactaacgtcggtctttcgtcgtcggtactaccgtaacgtcgtcgacgaccgtaccggtccctacccgngaaccttctaccgtcggtcggccttaccgaggcgtacggagggaccgtggtacttacgtaatttacgtcgtacgacgtactcgtaactaacgttaacgtaacgacgagaccgacgtacggaccttaaccgtacgttaaacccgggttttaccgaaccgggtaaccgggttaacccgggtaaaccccgtacggtttaaaccccgggtacccgtttaaacccggggtaacccgttaccggttaaacccgggaaacccccgttaaaacccggggaccccccgtttaaaaccccgtccggttttacccgtaaacccgttttaacccccgtaaccccggtttttaccccggttaaaccccccccgtttaaccccctttaaccccgttaaacccgtttaacccccggttttaaaccccgtaaaccccgggtttttacggtaaaccccccgggggtacgggggttacccccggggtttaaaccccgggtttcggggaaaaacccccggggtttaaacccccggggttacccctaaacgggggtttaaaacccccggttcccggggtttaacaaaccccgggttccgggttttaacccgaagttttttcccccggggggacg

SEQ ID NO: 199517 - DNA, 815 bp, Homo sapiens
  misc_feature: GYAE6OF02IZQQZ.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttcctgctgcttaatttaaaggtgtaccgagtgtgaggtgacgagctggtggagtcggtgggggaggcgttagggtaacgggcccgggggggttcccttaggtccctccccgttgtaccacggtcctcgtggtacttctactttacgaggtaacggccgtaggtaactggaacgttcgggtccgccgacggtccgtaccggaagggggacggggtcgtggggtacgggttggggttaccggaccggttaaaacgttaaaaaccccgtaaagtggtaacggttagggtaacggggtaaccaaccgtaagaacccgttacggaccgtaccggacccgtacccggtaaggtaaacggacgtaacgtaactttacccgaccgttactactaaccgagtaatagttacgtaacttaaacggaaaacgtccacgttacgtacgtactccgttaagaaccttaagtacgaacgtcgtaacccgaagggtaacccgaaccgggtaacgaccgtaacgtaccggtaccgttaagtttactaacccggtcgtaaaccctcccggtactaccccggtaaagggcccgtaaccgtaaccgttaaccttaccgttaacccgtacggttaacggtaccgttaccgaacggttccggggacccggtaacggg

SEQ ID NO: 199518 - DNA, 787 bp, Homo sapiens
  misc_feature: GYAE6OF02JIAZQ.18.59.F04.1.454.CMB.1.raw
  modified_base (347)..(347): a, c, t, g, unknown or other
  misc_feature (347)..(347): n is a, c, g, or t
  modified_base (701)..(701): a, c, t, g, unknown or other
  misc_feature (701)..(701): n is a, c, g, or t
tcagtacgagtatgcacgaccggtgctcgatttagtacacacacttagtgattggggggggtctcaggaggcagcgctctcgggacgtctccaccatggcctgggcctctgctattcctcacccctcctcacctcgaggcacaggggtcctgggccagtctcgcctgactcacgcctgcctccgtgtcgtgggtcctctcggacagtcgataccacctactcgtcctgccgacgtacggaccacggcaggtcgtacggttgggtagttaactaacgttgtcgtaccctccgttacggacctaaacgcaccgacccgaaggaccaaaacccacccccgtaaaccttanaacgttggttaaacttttaacgcggtagtttcggaacctacgtaaccgtcccggtactttaccgggttaaccgggggttttactaacgttccggtcgttttaccgtcgtttacggtaccgttaccgtaaacgggttcgtaccgggaacccttaaccgggacccgttaccccgtaccggtttaccaccgtttaaccggttccggttccgtccgggggtacctaccggaccggttgacgggtacgggacggtacgttcgtacggttatttacggtacgtaggtccgataccgtactaagttaccgtaacgaccgaacacgtaacttcctaacccgttctacgttgtttacccggtntaaccgggtaccggtaacggtaccggtaaccgtccggtaccttaccggtcgtaccgacccggacccgtaccggtacccctaaccgg

SEQ ID NO: 199519 - DNA, 638 bp, Homo sapiens
  misc_feature: GYAE6OF02JNLRF.18.59.F04.1.454.CMB.1.raw
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (631)..(631): a, c, t, g, unknown or other
  misc_feature (631)..(631): n is a, c, g, or t
  modified_base (634)..(636): a, c, t, g, unknown or other
  misc_feature (634)..(636): n is a, c, g, or t
tcagtacgagtatgcacgaccggtgctcgatttagtacacacacttagggattgggggctttgcctgggtcctgggcccagtctgcccctgactcagcctgcctccgtgtctgggtctcctggacagtcgatcaccatctcctgcactggaaccagcagtgacggttggttggttataactatgtctcctaggtaccaacagcacccaggcaaacgacccccaaactcatagtatttatgatgtcaactaatccggcctcgtagggtttctaatcgtctctctcggctaccagtctggaccacgccgccctcccgtcaccntcctcgtcgggtacctccggnggtacgttggacgggacggtacggtactttacgtttaagttaccgtcgacgtacncgttactaataacgttaacaaacgtccaacgacgtacctacctcgtacttagttccgtttacgtacgggtaacgttacggaacgtaccggtcgtacccgtcgtacggtacaccgacccgaaccgcccaacccgtatccggtactaccgttccctttccgtcccctacccttcccacccgtactcgtacccgtagtcgacggcggtcgacgggcctaacgggcacgtancgncgntcnnncg

SEQ ID NO: 199520 - DNA, 769 bp, Homo sapiens
  misc_feature: GYAE6OF02FK57Y.18.59.F04.1.454.CMB.1.raw
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (272)..(272): a, c, t, g, unknown or other
  misc_feature (272)..(272): n is a, c, g, or t
  modified_base (333)..(333): a, c, t, g, unknown or other
  misc_feature (333)..(333): n is a, c, g, or t
tcagtacgagtatgcacgaccggtgctcgatttagtacacacacttagggagttgggggggggtctcaggaggcagcgctcgtcgggacgtctccaccatggcctgggctctgctattcctcaccctcctcactcagggcacgagggtcctgggcccagtctgccctgactcagcctgcctcgtgtctgggtctcgtggacngtcgatccaccnttcctcctgctacgtcggaaaccagctagtcggtacggtttggttaggttaataactnttcgtccttccgtaggtaaccaacgcgacctaacccgaggaccaaaaccgccccctaaaanctaactggttaatttagacgtacgttacgtacctaacgttaacgtcccggtccctttagggttaacgggttttactaacgttccgttacctttccgtcgttacggtccctaccgtaaagttcgtacggaccgtaaccgcccggtccccttacctgtaacccgttatccgttcggttacggtccgtaccgacggtacgcggtaacgggtacggacggtactacggttatttaacgtccgtatacgtcgcgttaactaattaaccgtaacgacgtaaccacgtaacgtaccttaaccttacgttacgttaccgtacgtttacgttaacccgggaccggttaaccgggtaaacccttacgggttaacccgtacccggtttacgaaccggtttacccgaaccgaaccccggttaaaccggtcccccgaaccccttaccgg

SEQ ID NO: 199521 - DNA, 751 bp, Homo sapiens
  misc_feature: GYAE6OF02H9OJF.18.59.F04.1.454.CMB.1.raw
  modified_base (109)..(109): a, c, t, g, unknown or other
  misc_feature (109)..(109): n is a, c, g, or t
  modified_base (181)..(181): a, c, t, g, unknown or other
  misc_feature (181)..(181): n is a, c, g, or t
tcagtacgagtatgcacgaccggtgctcgatttagtacacacacttagggattggggggggggtctcaggaggcagcgctctcgggacgtctccaccatggcctgggcnctgctattcctcaccctcctcactcagggcacgacggttcctgggcccaggtctgccctagactcagcctcncctccgtgtctggtctactggacagtgatcaccatctcctgcacgtacggaaccagacagtaggacgtttggtaggtttaacaacttagtcgttccttaccgttacggaaccaaacgcacccaaccgacggaaccaaaccgaccccaaaacttacaagtacgttaattttagtagtaacgtacgttaccgtaaccgttaaccggtccggtaacccttcggttaacggggttttaccttaaacgttcccgttaccgtttactaccggttacggtacctaccgtaaacgttccgttacgggaacctaacccgtacggaccccttcccgttaagaccctaacttccgtcgtacgggtacccttaccggacggtacgtaacgggtaagaccggaaggtaccgttagttaacggtttaactacgttacgacgtacggtaaccactaacgttaaacgaacacgtaaccgacgaacctacaccttcttaacgtgttactacgttacggtaacgacggtaaccgtacgtacccgtacgtacgtacgttacgaccgtacccaacggaccccaccgtacg

SEQ ID NO: 199522 - DNA, 749 bp, Homo sapiens
  misc_feature: GYAE6OF02JKSSH.18.59.F04.1.454.CMB.1.raw
tcagtacgagtatgcacgaccggtgctcgatttagtacacacacttagggagttggggagctctgggagaggagccccagccttgggattcccaagtgttttcattcagtcgatcaggactgaacacagaggactcaccatggacgtttgggctgagctggattttccgtgctgcttatttaaaggtgtccagtcgtagaggtgcagtctgggtgagtcgtggggagcttggtaaacggccggggggtcccttagacctccccgtagtaccagccgtctggtacttctaactttcgaaggtaacggcctaggacttacggtaacgtcgggtcccgaccgtacgggcctaccggtaggggaacggggtctagggacgggtggggttcggaccgttaaagtaaaacccgaaatcggtagttcgggacgggaacaacgtcgaaccggttcgcttaggacccgtaaccgggagtaaaacgggctaaccggtaacttaccaacccgtagtaccgtacgaacgaggtactagactaacgtaaacggccaacgtctacgtactacgtacgaacgtaacgtgaacggacctcggaacgtaacccggaaacccggtagtaaccctaccgaaccgggttccgttaacgtttaaaccgtacttccgggtaaccctacgtaacccgtttaacccggataaaccggtccaaccgttacttaaccgtacttacgtaaccggtcgtacccgtagtaacccgggg

SEQ ID NO: 199523 - DNA, 699 bp, Homo sapiens
  misc_feature: GYAE6OF02IC6I7.18.59.F04.1.454.CMB.1.raw
  modified_base (235)..(235): a, c, t, g, unknown or other
  misc_feature (235)..(235): n is a, c, g, or t
  modified_base (694)..(694): a, c, t, g, unknown or other
  misc_feature (694)..(694): n is a, c, g, or t
tcagtacgagtatgcacgaccggtgctcgatttagtacacacacttagggattgggggggggtctcagggaggcagcgctctcgggacgtctccaccatggcctgggctctgctattcctcacctcctcactcagggcacgagggtccgtcgggccctagtctcgcctgacctcagcctcgtcctcgtcgtcgtgggtcctcctcggacgtacgtcgactcacctactctccgtnctacgtacggacacgacagtgtacggttggttacgttaactacttattcgttccttacgttacgtaaccacgtacgaccaccgaacgtaccgaaacccgacccctaaacgtctaacttaagttaacttttacggaagtacgttacgttaaccgtaacgttaacgtccggtaccgttacggttaacggtttactactcgttcttactcgtcgtacctacgtacgtcgacgtacgaaccgtccgtccctctacgtacgtacttcgtacggtcgttcctacgggtcgtacggtaggtacgggtacgtacggtacgtacgtttaattaccgtactcgtaccgtacgtaacctaataaccgacgtaaccgctaccgtactactacgtctacgtcgttcgtacgtacgacggtacgaacgtcgtactccgtacgacgtacgacgaccgtaccgtaccctaccgtntaccg

SEQ ID NO: 199524 - DNA, 824 bp, Homo sapiens
  misc_feature: GYAE6OF02HJZQ5.18.59.F04.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (538)..(538): a, c, t, g, unknown or other
  misc_feature (538)..(538): n is a, c, g, or t
  modified_base (605)..(605): a, c, t, g, unknown or other
  misc_feature (605)..(605): n is a, c, g, or t
tcagtacgagtatgcacgaccggtgctcgatttagtacacacacttagggagttgggggggggtctcaggaggcagcgctctcgggacgtctccacatggcctgggctctgctattcctcaccctctcactcgagggcacgagggtcctgggcccagtctgccctgacctcagcctgcacttccggtgtcgtgggtcctccgtggaacnggtcgaatccaaccatccgtccngactaacgtcggaaccagtaccaggtccggtaggtttgggtaggtttaactaacgttagttcggtccttaccgtacggtaccaacgacgaccaaccgacggacgaaaaccgtacccccaaactctactagtactttatcgatcgtactaacgtaacctccggtacccgttacggttaagggggtttacctaacgttccgtctttcgtcggtacgtccgttaccgtaaacgttcgacgtacgtaaaccgtccggtcccctaccgtaccggaacctcgttcggtccgtccggggtaccgttaaccggngggtaccggttacggaaacgggtacgggtacggtacttaagtttaacttaacgttacgtcggtaacncggtaccaccgttaaattaacgacgaaacccgttacgggaaccaccgttaaacctacggtttcctaaacgtttccggttacccttgggttaaacccccggtttaacggaaacccggggtaaaccgttaaccgggttaaaccccgttccccggtttaaccggtacgggttaacccaaccccggggtaacccctaacccggtaacccccgtaaaacccccg

SEQ ID NO: 199525 - DNA, 783 bp, Homo sapiens
  misc_feature: GYAE6OF02FP1FK.18.59.F04.1.454.CMB.1.raw
  modified_base (138)..(138): a, c, t, g, unknown or other
  misc_feature (138)..(138): n is a, c, g, or t
  modified_base (640)..(640): a, c, t, g, unknown or other
  misc_feature (640)..(640): n is a, c, g, or t
  modified_base (772)..(772): a, c, t, g, unknown or other
  misc_feature (772)..(772): n is a, c, g, or t
tcagtacgagtatgcacgaccggtgctcgatttagtacacacacttagggattggggggggtctcaggaggcagcgctctcgggacgtctccaccagtggcctgggctctgctattcctcaccctctcactcaggcanaggtcctggcccagtctgcctgactcagtcctgcctcgtgtcgtggtctctggactgtcgatccaacctatcctccgtgtacctacgtaggaaacccactaggtagtaccggtttggtacgttaataaccgtgtagttccctcggtacgtaaccaaacacggtacctaaccgaggaacctaaaacccgacccctaaagtcctagttacgtaattacagtacgtgtacctaacgtaccggttcccgaccgttacgggtaacggttactaacggtctccgttttacggccgttacggtaccctaacgtaaggtctacggacctaacggcccggttccctacgtaccggtactctcggtcgtaccgtcctaccggaggtacttacgggaacggtacgtaccgtacgttaacgtaacgttcgttacgtccgtacgtacgtacttaacgttgtaaccccgttaacggacgttaaccccggcgaaaccgttctaacccgtttaaccgntttaacggtccgttaaaccgtacgggtaccgttacggggtaacccggtaacggttcccccgtttaaccggtaggttccccgggaaaccgttcccggtaaacccggggtaaaccctcccccggtttaaaccgnggttacccccg

SEQ ID NO: 199526 - DNA, 724 bp, Homo sapiens
  misc_feature: GYAE6OF02IWXK8.18.59.F04.1.454.CMB.1.raw
  modified_base (244)..(244): a, c, t, g, unknown or other
  misc_feature (244)..(244): n is a, c, g, or t
  modified_base (578)..(578): a, c, t, g, unknown or other
  misc_feature (578)..(578): n is a, c, g, or t
tcagtacgagtatgcacgaccggtgctcgatttagtacacacacttagggattgggggctggggtctcaggaggcagcgctctcgggacgtctccacaatggcctgggctctgctattcctcaccctcctcactcagggcacagggtcctgggccctagtctgccctgacctcagcctgcccttccgtgtcgtgggtcctccgtggactagtcgactcacctatctctcgacacgtcggaaccngcctaaggttcgacggttggtagttaataactagtcgtcctccgtagtaccaacacgaccaacccgtaggaccaaaaccgtacccccaaaatccaacttacgtatttaactacggtattcggtactaacgtaaccgttcccgggacctaccggttagggttttacctaagttccgtcttacctcggtcgtctaccgtacggtccgcgtaaccaaccgtccggtcccctacctacgtacctcgtactacgtcgggtccctcggaggtcctaggacggacgtacgtcgttatagtttacgtactcgacaccgttgaaccttaagtacgaaccgtanacccgtaacgaacctacgtccggtttactttaccagtttccggtttacgtaaccgggtaacccggttacggtaaacccgttacgggttaacccctacgggttaaccgtaccggtcccgaaccggacccggtaaccctaacccccgg

SEQ ID NO: 199527 - DNA, 910 bp, Homo sapiens
  misc_feature: GYAE6OF02GXNVK.18.59.F04.1.454.CMB.1.raw
  modified_base (692)..(692): a, c, t, g, unknown or other
  misc_feature (692)..(692): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggtattttccgttgctgtacttaattttaaaaggtcgtctaggtgtgaggtgcagtcgtgggtaggtaggtcggtgggggaggtcgttagggtaaaccgggtcccgggggggttcccttacgacctccccgtacgtaccgacgtccgtacgtcggtacttcctaaccttttcgaaggttaacggccgttaggacgttaggtaaccggttccgggttaccccgaccggacggtccgtacccgggaaggggggaacgggggtccggttgggggtagggtttcgggggttcggggtaaccgtttaaaaccgttaaaaaaacccgtaaaacgttgtaaagggtttggggtaacggggtaaaccaaacgggtaaaccggaactttaaccggggaccgttcgacccggtaacccggtaagggaaacggactacggttactacccgaaacctaactacccgtaagaaaggattaacgtaacgtaacttaaaacggtaaaaacctcggtaacccggtacttaacggttacgtaccccttaggtaaanaaaacgtttacgaaaccgttaaccgaccgtaagggacccgaaaacggtaaccggaaacgaccgtaacggtaccgttaaagttcccttaacggtaccgtaaaccctcctaaccgttacccgaaggtaaaccggtccgtaaaacttaacccttaacgttaaccctaggtttacccgggtaactaccgggggttaccctagggtacccggggaaacccggg

SEQ ID NO: 199528 - DNA, 867 bp, Homo sapiens
  misc_feature: GYAE6OF02ISPBW.18.59.F04.1.454.CMB.1.raw
tcagtacgagtatgcacgaccggtgctcgatttagtacacacacttagggattgggggctggggtctcaggaggcagcgctctcgggactctccaccatggcctgggctctgctattcctcaccctctcactcgagggcacgacgggtcctgggcccagtctcgccctgactcagcctgcctcgtgtctggtctcctggactagtcgactcacctatctccgtgacctacgtacgaaccgagccgtaaggttacggttacggtttagggttaggttaaacttaacgttacgtcgtttaccgttaccgttacggttaaacccaacgacggtacccgaaccccggtaaggtaacccaaaacccggtaaccccctaaaccgtacgtaacgttacggttaactttaacgtagtaacgttcgtaacctaaacgttaaccggttacccggtacccgttacgggtttaacgggttttaacctaaacggttccgttaccgtttaccgttacccggttacgggtaccctttaacccggttaacggtcggttaaccggtaacccgtaaaacccggacccggttacccctttaccccggtacgtaaacccgttccgttaccggttaaccggttccgggaaccctttccgggaacgggttacgtacggggaacgggtaccggtaaccgttacgttaacgtttaagtttaaccgttaacgtcgggactaaccgtacgtacttaacgttaacgaacctaaccggacctaacgtacgtacctacgttacctacgttacttaccgttacgggttaaccacggttaccgggaacttaccgtcgtaccgtacgtacggacccgtacgtaccccgacgtaaccccg

SEQ ID NO: 199529 - DNA, 797 bp, Homo sapiens
  misc_feature: GYAE6OF02IDFKI.18.59.F04.1.454.CMB.1.raw
  modified_base (173)..(173): a, c, t, g, unknown or other
  misc_feature (173)..(173): n is a, c, g, or t
  modified_base (792)..(792): a, c, t, g, unknown or other
  misc_feature (792)..(792): n is a, c, g, or t
  modified_base (797)..(797): a, c, t, g, unknown or other
  misc_feature (797)..(797): n is a, c, g, or t
tcagtacgagtatgcacgaccggtgctcgatttagtacacacacttagggattgggggctttgcctgggtcctgggccagtctgccctgactcagcctgcctccgtgtctgggtctcctggacagtcgatcaccatctcctgcactggaaccagcagtgacgttggtgttaanactatgtctctggtacacagcaccagcaacgccccaaactcatgatttatgatgtacactaagtccgtcctccgtagggtttactaatccgtcttcgtcgtcggtctaccgtaacgtcgtacgacctaaaccgccggtcccgttccctacgacctaacgttcccgttggttccggtcccttaccgtaacgggcgttacgggaacgggtaccgacgggttccgttaggttaatttaactttaacgtcggactacggtctacgttaagtaaccttaacgaaagaccctaccgtaacgtaccgtaaccttactacttacggtttccgttaccggtttaaaccgggtaaccgttacgggggtaaaccccgttaagggttcccccgttaaaccccggtttaccggtacgggttaaccccgaacccggtaacccggtaaccccggtaacccccgaacccccttacggttacccgtaacccgtttaacccgttcccgttaccccgtttaccccctaccccggtttccctaacccgttaaacccggttccttaaccgggtaccgtacggtaccgggtaccggtacggtacgggtccgaacggggtaccagtacggtccgatcctagngtacn

SEQ ID NO: 199530 - DNA, 808 bp, Homo sapiens
  misc_feature: GYAE6OF02I9K36.18.59.F04.1.454.CMB.1.raw
  modified_base (203)..(203): a, c, t, g, unknown or other
  misc_feature (203)..(203): n is a, c, g, or t
tcagtacgagtatgcacgaccggtgctcgatttagtacacacacttagggagttggggggggtctcaggaggcagcgctctcgggacgtctccaccatggcctggctctgcttattcctcaccctcctcactcgaggcacgagggtcctgggcccagtcctgccctgactcagcctgcctcgtgtcgtgggtctccgtggacncgtcgactccaccattcctctgacctacgtacggaaccagactacgtaggtacggttggtacggttaactaacgttattcggtctaccgttacggtaaccctaacgacgaccgaaccccgtaggaaccgaaaacccgtccccccaaaacgtacctaaccgttaggttaacttttacgagtacgttacggttacctaacgttaacgtcccggtcccgttacgggttacggtttactaacgttcgtctttaccgtgtcgtacctacgtaagtttccacgggtacctaaccggcgtacccttcccgtacgtaaccttcgtctccggtacgggtccctacggtacggtcggtaacgtacgggaacgtcggtacttacgttaattacgtaccgttaggtacctagttacctacggtaacttaacgtaaccggaccgtaccctaaccggtcgttaaccctatttaccgtttaacgtaccgttttacggtttacccgtaacggtaacccgggttcgtaaaccgttaacccgggttcccaacccgggtttaccgttacgggaaccccctaccgggaaccccgtaaaccggttaccccctaccggtttaacccg

SEQ ID NO: 199531 - DNA, 911 bp, Homo sapiens
  misc_feature: GYAE6OF02HCGYV.18.59.F04.1.454.CMB.1.raw
  modified_base (202)..(202): a, c, t, g, unknown or other
  misc_feature (202)..(202): n is a, c, g, or t
tcagtacgagtatgcacgaccggtgctcgatttagtacacacacttagggattggggggggagaggagccccagcccttgggattcccaagtgtttccattcagtgatcaggactgaacacagaggactcaccatggaggtttggctgagctggatttttcctgtctgacttattttaaaaggtgtaccagtgttggaggtncagctggtggagtcgtgggggagtcgttagggtaaacgggcccggggggtcccttaggtaccctcccccgtagtaccacgtccttcgtggattctaccgttttcgaagtaacggccgtaggtagtacggtaaccgttcggggtcccgacccgtaggtcccgtacccgggaaagggggaacgggggtcccgtaggggaagggtttcgggggttacggggtaacccgttaaaaccgtttaaaaaaaccccgaaaacgttacggtaaggttacgggggtaacgggtaaaccaaacggtaacggtaaccgtaaccggtcgttcgaacccgtaccgggtaaggaaacgtacgaaggttacctaacccgtaacctaacgtaccgtaaacgtaacggtaacgtaaccgtagggttaaacttaaaaccggaaaaacgtaccgaaccgtttacggttaacgtaactaccggtagtaaacctaaaggtaacgaaaccgtaaccggtaccgaaacggtaaccgggaaacccggagaaacccggtacgaacggtacccgttacggttaacttaacgttaccgtaaacccctacgtaacccgttcccccgtaaggaaaccgttccggtaacctaaacccgttaaccttaacccttaaaccgttagtaaccggtttcccgaaccgttcccgggaacgggttacccgaacccgggtaaccccgg

SEQ ID NO: 199532 - DNA, 768 bp, Homo sapiens
  misc_feature: GYAE6OF02FS1TN.18.59.F04.1.454.CMB.1.raw
  modified_base (257)..(257): a, c, t, g, unknown or other
  misc_feature (257)..(257): n is a, c, g, or t
  modified_base (632)..(632): a, c, t, g, unknown or other
  misc_feature (632)..(632): n is a, c, g, or t
  modified_base (642)..(642): a, c, t, g, unknown or other
  misc_feature (642)..(642): n is a, c, g, or t
tcagtacgagtatgcacgaccggtgctcgatttagtacacacacttaggggattgggggctggggtctcaggaggcagcgctctcgggacgtctccaccatggcctgggctctgctattcctcaccctcctcactcgagggcacgacgggtcctcgggacccaggttctcgcccgttgactcgagcctcgccttcgtgtcgtgggtctccgtgactagtcgataccaccgtatcctacgtcgacacgtacggaaccngtcaggtcgtacgggtttggtgttaactaacgtagttcgtccttccgtcggtaaccaacgacgtaccacccgaggaccgaaacccgacccctaaacctacacgttagttaactttagtagtacgttacggtacctaaaccgtaacgttcccggtacccgtttacggtttaacggggtttaaccttaacggtccgttccgttccgtcgtccggttacctacccgttaaagtccgttaggaccctaaacccgccggtacccctcccgtacgtaacctcgttaccgtcggtcggtaccgttcgacggtctagggacggacggcgtaccgtagtactttacgttacgcgtacggactcgtctaataaccgtacgaaccncgtaaccgtnaccttactaacgttcttacgtaccgttaccgggaaccggttacgggtaaccgggtaacccgttaccggtaaccgtccggtttacccggtacgtaccgtaccgtacccgggaacccttaacccccgg

SEQ ID NO: 199533 - DNA, 742 bp, Homo sapiens
  misc_feature: GYAE6OF02G3PGE.18.59.F04.1.454.CMB.1.raw
tcagtacgagtatgcacgaccggtgctcgatttagtacacacacttagggattgggggagctctgggagaggagccccagccttgggattcccaagtgttttcattcagtgatcaggactgaacacagaggactcaccatggagttgggctgagctggattttcctgctgctatttaaaggtgtccagtgtgaggtgcgagctggtggagtcgtggggaggtcgttagggtaaacgggccggggggttaccttacgacctccccgtgtacacgcctcgtggtacttcacgtttcgagtaggcctaggactcgtaagtcgggtcccgacgacggtcctccggagggtacggggtcgtgggtacgggtcgggttacggacccggtttaaaagttaaaaaccccgaaaggttcggtaacggtacgggttacggaaaccgaacgtaaccggtaaccgtacgccgtacgacccgtaacccgtaagggaaacggcgtaaagtaccttacaccgtaactccgtaacgaggaacgttataaccggtaattaaaccgaaaaacgtcgtacggtactaacgtattaccgtagaaccctaatcgaaactcgggacaacggaacgtaaccggaacgtaagccgtaacgtccgttaagttcgttacccgataccgtaactcgttaacccgtaagaaccggtaccgtactaaaccgttctaaccgttaacggcgttaacgtcggtaccgtaccggg

SEQ ID NO: 199534 - DNA, 850 bp, Homo sapiens
  misc_feature: GYAE6OF02GVKLB.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttggctgagctggtattttccttgctgctattttaaaggtgtccagtgtgagtgcagctggtggagtcgtgggggaggtcgttagggtaaacgggccgggggggttacccttaggacctccccgtggtaccagccctcgtggtattcactttcaggtaacggtccgtaggagtcgaacgtcgggtcccgaccgacggccctaccggaggggtacggggtcgtcggggtaggttcggggttcggaccggttaaacttaaaaacccgaaaacgttgaagtacgggtacggaacaacgtaacggtacgtacggacctacggacccgaacccggttaggaaacggtcgtaaacgtaccgttaccaacccgtactaccgtacgaaaacggtacggtaaacgttacgtaaagtttaaaccgaaaaaacgtcccgtaacggtaccgtttaacggttaaacttcggttaacgaaccgttaaaaggttaaccgaaacgtaccggtcccgtaaaggggtaaaccgaaaccccgggtaagggaaaccaaccgggttaaccgtccgggttaaactttaacggttacccttacgttaacccaacctaacccggtttccccgtaaaggaaaccgtacccgttaaccctaaacccgtttaaccgttaacccggttaaaccgttaaccggtttaacggtcccggttaacccgtaaccggggg

SEQ ID NO: 199535 - DNA, 815 bp, Homo sapiens
  misc_feature: GYAE6OF02HVWR9.18.59.F04.1.454.CMB.1.raw
  modified_base (663)..(663): a, c, t, g, unknown or other
  misc_feature (663)..(663): n is a, c, g, or t
  modified_base (698)..(698): a, c, t, g, unknown or other
  misc_feature (698)..(698): n is a, c, g, or t
tcagtacgagtatgcacgaccggtgctcgatttagtacacacacttagggattggggtctgggagaggagccccagccttgggattcccaagtgttttcaattcagtgatcaggactgaacacagaggactcaccatggagtttggctgagctggacttttctgctgtcttagtttaaagtgtccagtgtgaggtgacagctgggtagagtccggtgggggagtcgttagggtaaacggcccggggggttaccttaggtacccgtccccgtaggttaaccacgttccctcgtacggtacttactactttacgacggttaaacggccgtaggtatacgtaacggtcgggtccgtaccgtacggtacccgttaccggaagggggaacgggtaccgttaggggaggtttacgggggtccggttaaaccgttaaaactttaaaaaaacccggaaacgttacgggtaaggttaccggggtaaccggggaaacctaaacggtacggtaaacccgttacggtaccgttaccggtacccgtaacccgtaaagggaaaacggttcccgaaagtaccttaccgaaccgttaactaccgtacgtaaagacgtatacgtaaacttaaacggaaaacgcggtacacggttactaacggtctaggaaaccttaaagngttaaacccgatcccggaaaggacgtaaacccggngaaccctaggtaaccggtccttaagttaactaccggaacttacccgattacccgactagaacgttcctaacaacgtacctagtaccggtactacgtccgtacgttcgggacgtaacc

SEQ ID NO: 199536 - DNA, 706 bp, Homo sapiens
  misc_feature: GYAE6OF02FPOES.18.59.F04.1.454.CMB.1.raw
  modified_base (483)..(483): a, c, t, g, unknown or other
  misc_feature (483)..(483): n is a, c, g, or t
tcagtacgagtatgcacgaccggtgctcgatttagtacacacacttagggattgggggtctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggagtcgttagggtaaacggtccgggggggtacccttaggacccgtcccctgtaccacgtcctcgtggtacttctactttcgacgttaaggccgtggatacggaacgtcggggtccgcgacggcctccggaggggaggggccgtagggtagggtcgggttcggaccgttaactaaaaccgaaagttgtacgtagggtacggaacaacgacgaactacggctcgacctacggtacggaaacggtcaagtactcacctatcagagagantaacttaacgaaaagcaacgtctagtactctacgtaacaaatacgaaccgtacgaccgtagaaaccgaacggaacgaacgaccgtagtaccgttaagttaacccttacggtaccgtacctaaccgtaccgtacccgtaaggtaacctaccgtaaccctaacgtaaccgttaaccttacggtaccggttacgaccggttacccgtccgggtacgggtaaccccg

SEQ ID NO: 199537 - DNA, 843 bp, Homo sapiens
  misc_feature: GYAE6OF02JWGWX.18.59.F04.1.454.CMB.1.raw
  modified_base (174)..(174): a, c, t, g, unknown or other
  misc_feature (174)..(174): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtccgtcgggcccagtcctcgccctgactnacgcctcgccctccgtgtcgtcggggtcctccgtggaccgagtcgactcacctatccgtcctgaccacgtcgggaaccngacgtagtcgtacgggtttggtagtttaactaaaccgttntacgttccttccgtacggttaacccaacgacgacccaaccccggaaggaaccgaaaccccgacccccgtaaaccgtacctaggttagttaactttagtacgtagtaccggtacctaacgtaacggttacccggtcccgttacggttacgggttttacttaacgtccgtacctttcgttccgttacggtcctaaccgtaaggttcccgaacggacccttaaccgccccggtcccttaccccggtaccgtaaccctcgtttcccgttccggtcggtcccgtaccggtaccgggtcggtaacgggaaccgggtacggtaccggtacgtttaaccgtaagtttacgtttaccgttcggtcctaccggttacttaaccgttacgttaaaccgaacgtaaccgaccaaccgacgtccttcgtaactttacgtacgttcggttaccgttacggtaaccgtccgggttaacccgtaacgggtcccggtttaacccgttccgggtaccccgtacggacccccgtaacccggtaacccccgtacccgtaaccccgtccgg

SEQ ID NO: 199538 - DNA, 649 bp, Homo sapiens
  misc_feature: GYAE6OF02HOAMO.18.59.F04.1.454.CMB.1.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
  modified_base (395)..(395): a, c, t, g, unknown or other
  misc_feature (395)..(395): n is a, c, g, or t
  modified_base (453)..(453): a, c, t, g, unknown or other
  misc_feature (453)..(453): n is a, c, g, or t
  modified_base (491)..(491): a, c, t, g, unknown or other
  misc_feature (491)..(491): n is a, c, g, or t
  modified_base (499)..(499): a, c, t, g, unknown or other
  misc_feature (499)..(499): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
tcagtacgagtatgcacgaccggtgctcgatttagtacacacacttagggagttgggggggggtctcagggaggcagcgctctcgggacgtctccaccatggcctgggctctgctatcctcaccctctcactcagggcacgagggtcctcgggccctaggtcctcgcccgtgaacctcgacgcctcgcctccgtggtccgtgggtctccgtggacacggtcatccaccnctctccngacacgtacgactagcagtcgtcggttggtagttataatgtcacctcgtacggaaccaacggnacccaacgacggaacaacccgtacccctaaagctatataattntagtattcaacgtactacgtccgccgtacgtacggtttacaacgtcgtctcgngtacgaacgtctaacgcgtgacacgtccgcctgaccactcttccgcgacggtcgacgngtacgagacggacgtaggaccgtatattaacgtttcgngacacgtnaccgtaatacgtacgaacgtcaacgaactcaaccgtnttcngttacgtacgttacggaccggttaccgaacggttaacctccggtaaaccgttccggtaacgggtcccaaccggtaacccgaacccgtaccccggtaaccctttaacccg

SEQ ID NO: 199539 - DNA, 589 bp, Homo sapiens
  misc_feature: GYAE6OF02GAP82.18.59.F04.1.454.CMB.1.raw
  modified_base (251)..(251): a, c, t, g, unknown or other
  misc_feature (251)..(251): n is a, c, g, or t
  modified_base (259)..(259): a, c, t, g, unknown or other
  misc_feature (259)..(259): n is a, c, g, or t
  modified_base (558)..(558): a, c, t, g, unknown or other
  misc_feature (558)..(558): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
  modified_base (576)..(576): a, c, t, g, unknown or other
  misc_feature (576)..(576): n is a, c, g, or t
  modified_base (579)..(589): a, c, t, g, unknown or other
  misc_feature (579)..(589): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaacgcccccaaactcatgatttatgatgtcactaagtccggccctcgtaggggtttctaatcgcttctctgctaccagtctggcaacncgcctccngaccatctctgggctccgaggtcctaggaggacgaggcttagtatttattactgcagcctacataacacagccacagcctactctatatcgttacgtacggacgtagggacctacggtccacccggtactacggccacggtaccccaaacggaccccaaccccgacgttacgtacctaccgttcccgttacccgttccccctaaccccgttccctaccctaaccgttacccttacgtaccgtcgggacggtccggggtacgttacgggaccgaacgggtaccgtacgtagtacgcgtcncggtncngcngcgcgcgncgnnnnnnnnnnn

SEQ ID NO: 199540 - DNA, 767 bp, Homo sapiens
  misc_feature: GYAE6OF02JU5EF.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcaggcacagggtcctgggcccagtctcgccctgactcagcctgcctcgtgtctgggtctcgtggacagtcgactcacatcctcctgacacgtcggaacctgcgtagtcgtacggttggtagttaactaacttgtcgttcctaccgttacggtaaccctaacgtacgaccaacccgtacgggaccgtaaaaaccgtcccccgtaaaacgttccaacgttcgtaattttacgacgtaacttcggtaacctaccgttaacgtcccggtcccttagggtttaccgggtttactaacgtccgttccttcgttcgttacggtccttaaccggtagtttccgtacggaccctaaacggtcccgtccctacccgtacgtacccgtcgttacgtccgtaccgggttccctccgtaacgggtcgtaggaaccggtacgggtacgttccgtaacgttctttaacccgtttaaccgtcgtaccgttaaacgtccgtttcgtaaacttaacgtaccgaaacgtcccgtaacggtcctaaccttcgttacttaccgttagttcgtaccgttacggtaacggtccgtaaccgtacggtacccgtacctaccggttcgactacccggaccgtaccggcccctaacgttccgg

SEQ ID NO: 199541 - DNA, 748 bp, Homo sapiens
  misc_feature: GYAE6OF02FRC8W.18.59.F04.1.454.CMB.1.raw
  modified_base (227)..(227): a, c, t, g, unknown or other
  misc_feature (227)..(227): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctctcactcagggcacagggtcctgggcccagtctgccctgactcagcctgcctccgtgtctgggtctctggacagtcgatcaccatctcctgcactggaaccngctagtgtacgttggtggttataacgtatcgtctccgtaggtacctaacagccacccgaggaccaaaccgtaccccccgtaaaactcaacgtacgtaattttacgtagtaacttacggaccttaaccgtaacgtcccgggtaccccttaccggtaaggggttttacctaaacgttccgttaccgtttaccgtcgttcggaccttaacccgtaagttcgtaggacccaaaccgtcccggtaccctaccccggtagtaaccgtacgtctacgggtcgggtcctaccgcggtatacgggtaacggacgtacggtctaagttatttaacttaccgtagcccgtagtaccttaaccgtaagttaacgtaacgtaacgaccgaaccgtacgacctaacgttaccctagtttacgtacgtttcgttaacggaaccggttacgggaaaccgttaccggtaccgttaacccggtaccgttacggtaccggtacccgtacccggaacccggacccctaacccgttaaccgg

SEQ ID NO: 199542 - DNA, 490 bp, Homo sapiens
  misc_feature: GYAE6OF02GDJGY.18.59.F04.1.454.CMB.1.raw
  modified_base (177)..(177): a, c, t, g, unknown or other
  misc_feature (177)..(177): n is a, c, g, or t
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (428)..(428): a, c, t, g, unknown or other
  misc_feature (428)..(428): n is a, c, g, or t
  modified_base (431)..(438): a, c, t, g, unknown or other
  misc_feature (431)..(438): n is a, c, g, or t
  modified_base (440)..(490): a, c, t, g, unknown or other
  misc_feature (440)..(490): n is a, c, g, or t
tcagtacgagtatgcacgaccggtgctcgatttagtacacacacttagggattgggggagagaagacaggattcaggacaatctccagcatggcccggcttccctctcctcctcacccctcctcactcactgtgcagggtcctgggcccagtctgtgctcgactcgacgccaccctnagcgtctcgggacccccggnaggacggtcaccatctcttgttcgnggaagcagcctccaaacagtacggaacgtccagaccccgaaaggccttcccgcccccccgttcggtaccctaccgttccctttaccggtttcccccctaaccccctttcccccttacctaacttaacccgttcgttaaccgtcgggaaaccgggtccgggggtccttaccgggaccggtaaaccggggccgtaccgaaagttcgancgnnnnnnnngnnnnnnnnnnnnnnnnnnnnnnnnnnnnnnnnnnnnnnnnnnnnnnnnnnn

SEQ ID NO: 199543 - DNA, 680 bp, Homo sapiens
  misc_feature: GYAE6OF02FLLW2.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgttgggtaaacggcccgggggggtcccttagaccgttccccctagtaccacgtccctcgtggacttctactttcgagtaacggtcctaggatcgaacgtgggtacccgccgaggcctccggaggggaagggtcctgggaggtgggttggaccgttaattaaaaaccgaaactggaagtagggtaggaacaacgagaactacgactagccaccgtagaaacggtcaagtacttcgaccactactacgaaagagtactagtaacttaacgaaaaagccaacgtctacgtactacgtagaacgtaaagtacgaaacgacgacctaggaacgaaccgagaaccacgacgtccgttaacgtacttaccgtagtaaccctactacccgttaccgagtaaccgtaccgtaactaaccctactacgttaacgtacggtacgtacggtaccgtcggtacggaacccgg

SEQ ID NO: 199544 - DNA, 668 bp, Homo sapiens
  misc_feature: GYAE6OF02G8244.18.59.F04.1.454.CMB.1.raw
  modified_base (157)..(157): a, c, t, g, unknown or other
  misc_feature (157)..(157): n is a, c, g, or t
  modified_base (197)..(197): a, c, t, g, unknown or other
  misc_feature (197)..(197): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (306)..(306): a, c, t, g, unknown or other
  misc_feature (306)..(306): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtcngccctgactcagcctgccttccgtgtctggtctctggacngtcgatccacatctctgacactggaaccagcagtgacgttggtagttanactntgtctctgtaccanagcaccngcaacgccccaatcatgatttatgatnctagtacncgcctgtacgggtttcaacgtcgtcgttctacgtcgctaccgtaagtctacggacctaacggaccgtccgtcccgtagaccctaagttccgtaccggtcgggtaccctccggtaagggtccctagggaacgggtaccggtacgggaccttagtaagtttaacgttaccgtggaccgtacggtaccttacgaacttacttaaccgacgtaccgagtaccgaaccggtactaaccgttacgaacgtttcccgtaaccgggtaacgttacgggaaacccgttaaggtccctaaccggttcccgttaaggttacccgaaccggttaccccgaacccggaccccctaaacccggttacgttaacccg

SEQ ID NO: 199545 - DNA, 714 bp, Homo sapiens
  misc_feature: GYAE6OF02GO709.18.59.F04.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (308)..(308): a, c, t, g, unknown or other
  misc_feature (308)..(308): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcaggcacagggtcctgggcccagtctgccctgactcagcctgcctccgtgtctgggtctcgtggacagtcgatcaccatctcctgcactgaaccngcagtgacgttggagttataactntntctcctggtaccanagccaccgaggacaaccgaccccaaactcatagtactttagngtatcgtacacgtaagtccgccctaggttacgggtttactaacgtccgttacctttacgttcgtacggtacctaccgtaaccgtttcgacggaccaaccgtacccggtcccgtccgtacaaccgtactccggttccgtcggtcctaccggacggtaccgttacgggaacgggtaccggacgtccgttagtaacgttttaacgttaccgtcgtactaccgtaccttactaaagttacgtaaacgaacgtaccgaacgtacgtaacgtacctacgttaacccgtaacgttacgttaccgggaacgtaccggggtaaccgttaaccgggtacccgtaccggttacccgtaacggtacccggaacccgtaacccgtacccggaaccccgtaaccccggttacttacccgg

SEQ ID NO: 199546 - DNA, 833 bp, Homo sapiens
  misc_feature: GYAE6OF02G52IW.18.59.F04.1.454.CMB.1.raw
  modified_base (532)..(532): a, c, t, g, unknown or other
  misc_feature (532)..(532): n is a, c, g, or t
tcagtacgagtatgcacgaccggtgctcgatttagtacacacacttagggagttggggagctctgggagaggagccccagccttgggattcccaagtgttttcattcagtgatcaggactgaacacagaggactcaccatggagttgggctgagctggacttttcctgctgcttaatttaaaggtgtacagtgtgagtgcagctggtgagtcggtggggagtacgttggtaaacggccggggggttaccttaggacctccccgtagtacgacgccgtcgtggtacttacctactttacgaacggtaacggcgtacggtaagtcgtaaacgtcggggtcccacgtaacggtcctacccggaagggggtaaggggtcctagggggtacggttcggggggttacgaacggtttaaaacgttaaaaaaacccgaaaacgttacggaaggttccgggttaaggggaaaccgtaaaaccgtacgggaaaccgtacggtaccgtacgtacccggaacccggttaagggaaacccgggtnaaaccggtacttacccgaacctaagttacctaaccgaaaggtacggaacgtaacgtaattaaaccggaaaaactccgaaacgttacgtacgttaaccgttaccgtaagtaaaccgtaaagtaacggaaaccttacggaccgtaccgggaaacgacccggtaaacggaccgtaaaccgacggttaacccgtattaaacgttacctacccggttaaccaccggtttacccgaccgtaaacgtaaccgccgttaacctaacgtaacgttacgtaaccgtacgtacgtaccggtaccttacgggg

SEQ ID NO: 199547 - DNA, 757 bp, Homo sapiens
  misc_feature: GYAE6OF02G31AD.18.59.F04.1.454.CMB.1.raw
  modified_base (354)..(354): a, c, t, g, unknown or other
  misc_feature (354)..(354): n is a, c, g, or t
  modified_base (581)..(581): a, c, t, g, unknown or other
  misc_feature (581)..(581): n is a, c, g, or t
tcagtacgagtatgcacgaccggtgctcgatttagtacacacacttagggattggggtctgggagaggagccccagccttgggattccccaagtgttttcattcagtgatcaggactgaacacagaggactccaccatggagtttgggctgagctggattttccttgctgcttatttaaaagtgtccagtgtgagtgcagcgtggtggagtcggtgggggagtcgttagggtaaacgggcccgggggggttcccttagcccgttccccgtagtacctagtcccgtctaggtacttccgtacctttccgaaggttaacggaccgttgggaattacggaaacggttcggggtcccnccgtaaggccctaccggaagggggaagggccgtggggagggttcgggtaggtaccggttaaaactaaaaacccgaaaagtcggaaggttacgggtacggaacgaaacgacgaacgtacggcttacgccaaccggtaggaaacggcaacgtactacccgaaccgaactttccgaacgaaacgtagaagttaacgaactaaacgaaaaccgcctaagtacttagtaccncgtacaactaaaaggtcaaacgtcgacgtaacgaaacgtaacggacaaccgtactaccgggtcttacgttaactaccgtaacgacccactcccgtaacccgtaagaaccgtacctaaccgtaactaacgtaccgtacgtaccggttagtcccgaccgtttcggacggtaaccccgg

SEQ ID NO: 199548 - DNA, 869 bp, Homo sapiens
  misc_feature: GYAE6OF02GF3HS.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctccaccctcctcactcagggcacagggtcctgggcccagtctgccctgactcagcctgcctcgtgtcgtcggtctccgtggacagtcgatcactagtcctcctgacctacgtacggaaccagactaggtcgtaccggtttaggtcgttaataaccgtagtcgttccgtaccgtacggtaaccaacgtacgtacccaaccgtaacggaacctaaaccccgtacccccaaaacttccgaattgtaacttttagacgttatcggtactaacgttaacgtccggtacccttagggttaacgggtttactaaccgttccgtacctttcgtacgttccggtaccttaaccggtaacggtttccgtaacggacccaaccggtcccgtacccgtacccgttacgaacccgtttacgttccgttacccggttacgggtcccttaaccgggtcggtaacggtaacggggtacgggacggttacggtacgtttaggttaacgtttaacttaccggttggaaccgttacgttacctaacgtacgttaaaccgtaacgtaaccgtaacccgtaacccgtaacgttacccttaaaccgtttccttaacgggttaacgttcccgtttaccggttaacccggggtacggttaaacccgggttaaacccgtaccgggttacccgttaaccccggttaaccggtttaccggtaacccgtaaccccgggaaccccgtttaacccgggaacccccctaccgtttaccccgg

SEQ ID NO: 199549 - DNA, 130 bp, Homo sapiens
  misc_feature: GYAE6OF01EM7V2.12.55.E11.1.454.CMB.1.raw
  modified_base (129)..(130): a, c, t, g, unknown or other
  misc_feature (129)..(130): n is a, c, g, or t
tcagatacgacgtacacgaccggtgctcgattagcactcgcacgttggttggctctggcacagcggcctggctgcctggtcaaggactacttcctacgtcgtatctgagcggctggcaaggcgcatagnn

SEQ ID NO: 199550 - DNA, 206 bp, Homo sapiens
  misc_feature: GYAE6OF01BEQR4.12.55.E11.1.454.CMB.1.raw
  modified_base (203)..(206): a, c, t, g, unknown or other
  misc_feature (203)..(206): n is a, c, g, or t
tcagatacgacgtacacgaccggtgctcgatttagcactcgcacgttgggtttggggaggtgtgtcacaagatttgggctctgggcaccgtgggcatggggaggtgtgtcacaagatttgggctctgggcacagcggccctgggctgcctggtcaaggactacttcctacgtcgtatctgagcgggctggcaaggcgcatagnnnn

SEQ ID NO: 199551 - DNA, 174 bp, Homo sapiens
  misc_feature: GYAE6OF01DBBEZ.12.55.E11.1.454.CMB.1.raw
  modified_base (173)..(174): a, c, t, g, unknown or other
  misc_feature (173)..(174): n is a, c, g, or t
tcagatacgacgtacacgaccggtgctcgatttagcactcgcacgttgggtttggggaagaggaagactgacggtcctcccaggagttcaggtgctgggcacagcggccctgggctgcctggtcaaggactacttcctacgtcgtatctgagcgggctggcaaggcgcatagnn

SEQ ID NO: 199552 - DNA, 130 bp, Homo sapiens
  misc_feature: GYAE6OF01B2V5X.12.55.E11.1.454.CMB.1.raw
  modified_base (130)..(130): a, c, t, g, unknown or other
  misc_feature (130)..(130): n is a, c, g, or t
tcagatacgacgtacacgaccggtgctcgatttagcactcgcacgttgggtttgggcacagcggccctgggctgcctggtcaaggactacttcctacgtcgtatctgagcgggctggcaaggcgcatagn

SEQ ID NO: 199553 - DNA, 164 bp, Homo sapiens
  misc_feature: GYAE6OF01EMNOE.12.55.E11.1.454.CMB.1.raw
  modified_base (159)..(164): a, c, t, g, unknown or other
  misc_feature (159)..(164): n is a, c, g, or t
tcagatacgacgtacacgaccggtgctcgatttagcactcgcacgttgggtttggggaggtgtgtcacaagatttgggctctgggcacagcggccctgggctgcctggtcaaggactacttccgagtgcgtctctgagcgggctggcaaggcgcatagnnnnnn

SEQ ID NO: 199554 - DNA, 174 bp, Homo sapiens
  misc_feature: GYAE6OF01D2OQV.12.55.E11.1.454.CMB.1.raw
  modified_base (174)..(174): a, c, t, g, unknown or other
  misc_feature (174)..(174): n is a, c, g, or t
tcagatacgacgtacacgaccggtgctcgatttagcactcgcacgttgggtttgggggaagaggaagactgacggtcctcccaggagttcaggtgctgggcacagcggccctgggctgcctggtcaaggactacttcctacgtcgtatctgagcgggctggcaaggcgcatagn

SEQ ID NO: 199555 - DNA, 161 bp, Homo sapiens
  misc_feature: GYAE6OF01AK36M.12.55.E11.1.454.CMB.1.raw
  modified_base (159)..(161): a, c, t, g, unknown or other
  misc_feature (159)..(161): n is a, c, g, or t
tcagatacgacgtacacgaccggtgctcgatttagcactcgcacgttgggtttggggaggtgtgtcacaagatttgggctctgggcacagcggccctgggctgcctggtcaaggactacttccgagtgcgtctctgagcgggctggcaaggcgcatagnnn

SEQ ID NO: 199556 - DNA, 257 bp, Homo sapiens
  misc_feature: GYAE6OF01DV6YD.12.55.E11.1.454.CMB.1.raw
  modified_base (256)..(257): a, c, t, g, unknown or other
  misc_feature (256)..(257): n is a, c, g, or t
tcagatacgacgtacacgaccggtgctcgatttagcactcgcacgttgggtttggggaagaggaagactgacggtcctcccaggagttcaggtgctgggcaccctggtcactgtctcctcggcttccaccaagggcccatcggtcttccccctggcgccctgctccaggagcacctctggggcacagcggccctgggctgcctggtcaaggactacttcctacgtcgtatctgagcgggctggcaaggcgcatagnn

SEQ ID NO: 199557 - DNA, 174 bp, Homo sapiens; identical to SEQ ID NO: 199551
  misc_feature: GYAE6OF01CTRMY.12.55.E11.1.454.CMB.1.raw
  modified_base (173)..(174): a, c, t, g, unknown or other
  misc_feature (173)..(174): n is a, c, g, or t

SEQ ID NO: 199558 - DNA, 175 bp, Homo sapiens
  misc_feature: GYAE6OF01BJ6XG.12.55.E11.1.454.CMB.1.raw
  modified_base (174)..(175): a, c, t, g, unknown or other
  misc_feature (174)..(175): n is a, c, g, or t
tcagatacgacgtacacgaccggtgctcgatttagcactcgcacgttgggtttgggggaagaggaagactgacggtcctcccaggagttcaggtgctgggcacagcggccctgggctgcctggtcaaggactacttcctacgtcgtatctgagcgggctggcaaggcgcatagnn

SEQ ID NO: 199559 - DNA, 161 bp, Homo sapiens
  misc_feature: GYAE6OF01BRAVI.12.55.E11.1.454.CMB.1.raw
  modified_base (160)..(161): a, c, t, g, unknown or other
  misc_feature (160)..(161): n is a, c, g, or t
tcagatacgacgtacacgaccggtgctcgatttagcactcgcacgttgggtttgggggaggtgtgtcacaagatttgggctctgggcacagcggccctgggctgcctggtcaaggactacttccgagtgcgtctctgagcgggctggcaaggcgcatagnn

SEQ ID NO: 199560 - DNA, 160 bp, Homo sapiens
  misc_feature: GYAE6OF01DUYUR.12.55.E11.1.454.CMB.1.raw
  modified_base (159)..(160): a, c, t, g, unknown or other
  misc_feature (159)..(160): n is a, c, g, or t
tcagatacgacgtacacgaccggtgctcgatttagcactcgcacgttgggtttggggaggtgtgtcacaagatttgggctctgggcacagcggccctgggctgcctggtcaaggactacttccgagtgcgtctctgagcgggctggcaaggcgcatagnn

SEQ ID NO: 199561 - DNA, 185 bp, Homo sapiens
  misc_feature: GYAE6OF01DASRR.12.55.E11.1.454.CMB.1.raw
  modified_base (161)..(185): a, c, t, g, unknown or other
  misc_feature (161)..(185): n is a, c, g, or t
tcagatacgacgtacacgaccggtgctcgatttagcactcgcacgttgggtttggggaggtgtgtcacaagagtttgggctctgggcacagcggccctgggcctgcctggtcaaggactacttccgagtgcgtctctgagcgggctggcaaggcgcatagnnnnnnnnnnnnnnnnnnnnnnnnn

SEQ ID NO: 199562 - DNA, 231 bp, Homo sapiens
  misc_feature: GYAE6OF01BV1LZ.12.55.E11.1.454.CMB.1.raw
  modified_base (219)..(231): a, c, t, g, unknown or other
  misc_feature (219)..(231): n is a, c, g, or t
tcagatacgacgtacacgaccggtgctcgatttagcactcgcacgttgggtttgggggaaggaggaagactgacggtcctcccaggagttcaggtgctgggcaccgtgggcatggggaggtgtgtcacaagatttgggctctgggcacagcggccctgggctgcctggtcaaggactacttcctacgtcgtatctgagcgggctggcaaggcgcatagnnnnnnnnnnnnn

SEQ ID NO: 199563 - DNA, 205 bp, Homo sapiens
  misc_feature: GYAE6OF01AT7EK.12.55.E11.1.454.CMB.1.raw
  modified_base (203)..(205): a, c, t, g, unknown or other
  misc_feature (203)..(205): n is a, c, g, or t
tcagatacgacgtacacgaccggtgctcgatttagcactcgcacgttgggtttggggaggtgtgtcacaagatttgggctctgggcaccgtgggcatggggaggtgtgtcacaagatttgggctctgggcacagcggccctgggctgcctggtcaaggactacttcctacgtcgtatctgagcgggctggcaaggcgcatagnnn

SEQ ID NO: 199564 - DNA, 175 bp, Homo sapiens; identical to SEQ ID NO: 199558
  misc_feature: GYAE6OF01CE8IN.12.55.E11.1.454.CMB.1.raw
  modified_base (174)..(175): a, c, t, g, unknown or other
  misc_feature (174)..(175): n is a, c, g, or t

SEQ ID NO: 199565 - DNA, 219 bp, Homo sapiens
  misc_feature: GYAE6OF01B829J.12.55.E11.1.454.CMB.1.raw
  modified_base (217)..(219): a, c, t, g, unknown or other
  misc_feature (217)..(219): n is a, c, g, or t
tcagatacgacgtacacgaccggtgctcgatttagcactcgcacgttgggtttggggaagaggaagactgacggtcctcccaggagttcaggtgctgggcaccgtgggcatggggaggtgtgtcacaagatttgggctctgggcacagcggccctgggctgcctggtcaaggactacttcctacgtcgtatctgagcgggctggcaaggcgcatagnnn

SEQ ID NO: 199566 - DNA, 221 bp, Homo sapiens
  misc_feature: GYAE6OF01CL7UN.12.55.E11.1.454.CMB.1.raw
  modified_base (218)..(221): a, c, t, g, unknown or other
  misc_feature (218)..(221): n is a, c, g, or t
tcagatacgacgtacacgaccggtgctcgatttagcactcgcacgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctacgtcgtatctgagcgggctggcaaggcgcatgnnnn

SEQ ID NO: 199567 - DNA, 174 bp, Homo sapiens; identical to SEQ ID NO: 199554
  misc_feature: GYAE6OF01EWSQP.12.55.E11.1.454.CMB.1.raw
  modified_base (174)..(174): a, c, t, g, unknown or other
  misc_feature (174)..(174): n is a, c, g, or t

SEQ ID NO: 199568 - DNA, 176 bp, Homo sapiens
  misc_feature: GYAE6OF01ECNGU.12.55.E11.1.454.CMB.1.raw
  modified_base (174)..(176): a, c, t, g, unknown or other
  misc_feature (174)..(176): n is a, c, g, or t
tcagatacgacgtacacgaccggtgctcgatttagcactcgcacgttgggtttgggggaagaggaagactgacggtcctcccaggagttcaggtgctgggcacagcggccctgggctgcctggtcaaggactacttcctacgtcgtatctgagcgggctggcaaggcgcatagnnn

SEQ ID NO: 199569 - DNA, 174 bp, Homo sapiens; identical to SEQ ID NO: 199554
  misc_feature: GYAE6OF01DY45B.12.55.E11.1.454.CMB.1.raw
  modified_base (174)..(174): a, c, t, g, unknown or other
  misc_feature (174)..(174): n is a, c, g, or t

SEQ ID NO: 199570 - DNA, 258 bp, Homo sapiens
  misc_feature: GYAE6OF01EU4JB.12.55.E11.1.454.CMB.1.raw
  modified_base (256)..(258): a, c, t, g, unknown or other
  misc_feature (256)..(258): n is a, c, g, or t
tcagatacgacgtacacgaccggtgctcgatttagcactcgcacgttgggtttgggggaagaggaagactgacggtcctcccaggagttcaggtgctgggcaccctggtcactgtctcctcggcttccaccaagggcccatcggtcttcccctggcgccctgctccaggagcacctctgggggcacagcggccctgggctgcctggtcaaggctacttcctacgtcgtatctgagcgggctggcaaggcgcatagnnn

SEQ ID NO: 199571 - DNA, 220 bp, Homo sapiens
  misc_feature: GYAE6OF01DE2OR.12.55.E11.1.454.CMB.1.raw
  modified_base (218)..(220): a, c, t, g, unknown or other
  misc_feature (218)..(220): n is a, c, g, or t
tcagatacgacgtacacgaccggtgctcgatttagcactcgcacgttgggtttgggggaagaggaagactgacggtcctcccaggagttcaggtgctgggcaccgtgggcatggggaggtgtgtcacaagatttgggctctgggcacagcggccctgggctgcctggtcaaggactacttcctacgtcgtatctgagcgggctggcaaggcgcatagnnn

SEQ ID NO: 199572 - DNA, 206 bp, Homo sapiens; identical to SEQ ID NO: 199550
  misc_feature: GYAE6OF01B99IQ.12.55.E11.1.454.CMB.1.raw
  modified_base (203)..(206): a, c, t, g, unknown or other
  misc_feature (203)..(206): n is a, c, g, or t

SEQ ID NO: 199573 - DNA, 162 bp, Homo sapiens
  misc_feature: GYAE6OF01A8ZKF.12.55.E11.1.454.CMB.1.raw
  modified_base (159)..(162): a, c, t, g, unknown or other
  misc_feature (159)..(162): n is a, c, g, or t
tcagatacgacgtacacgaccggtgctcgatttagcactcgcacgttgggtttggggaggtgtgtcacaagatttgggctctgggcacagcggccctgggctgcctggtcaaggactacttccgagtgcgtctctgagcgggctggcaaggcgcatagnnnn

SEQ ID NO: 199574 - DNA, 206 bp, Homo sapiens; identical to SEQ ID NO: 199550
  misc_feature: GYAE6OF01AVR7C.12.55.E11.1.454.CMB.1.raw
  modified_base (203)..(206): a, c, t, g, unknown or other
  misc_feature (203)..(206): n is a, c, g, or t

SEQ ID NO: 199575 - DNA, 176 bp, Homo sapiens; identical to SEQ ID NO: 199568
  misc_feature: GYAE6OF01EMC42.12.55.E11.1.454.CMB.1.raw
  modified_base (174)..(176): a, c, t, g, unknown or other
  misc_feature (174)..(176): n is a, c, g, or t

SEQ ID NO: 199576 - DNA, 176 bp, Homo sapiens; identical to SEQ ID NO: 199568
  misc_feature: GYAE6OF01BE48J.12.55.E11.1.454.CMB.1.raw
  modified_base (174)..(176): a, c, t, g, unknown or other
  misc_feature (174)..(176): n is a, c, g, or t

SEQ ID NO: 199577 - DNA, 206 bp, Homo sapiens
  misc_feature: GYAE6OF01CV7LR.12.55.E11.1.454.CMB.1.raw
  modified_base (203)..(206): a, c, t, g, unknown or other
  misc_feature (203)..(206): n is a, c, g, or t
tcagatacgacgtacacgaccggtgctcgatttagcactcgcacgttgggtttgggggaggtgtgtcacaagatttgggctctgggcaccgtgggcatgggggaggtgtgtcacaagatttgggctctgggcacagcggccctgggctgcctggtcaaggactatcctacgtcgtatctgagcgggctggcaaggcgcatagnnnn

SEQ ID NO: 199578 - DNA, 174 bp, Homo sapiens; identical to SEQ ID NO: 199554
  misc_feature: GYAE6OF01DPLL3.12.55.E11.1.454.CMB.1.raw
  modified_base (174)..(174): a, c, t, g, unknown or other
  misc_feature (174)..(174): n is a, c, g, or t

SEQ ID NO: 199579 - DNA, 177 bp, Homo sapiens
  misc_feature: GYAE6OF01DZ1A0.12.55.E11.1.454.CMB.1.raw
  modified_base (174)..(177): a, c, t, g, unknown or other
  misc_feature (174)..(177): n is a, c, g, or t
tcagatacgacgtacacgaccggtgctcgatttagcactcgcacgttgggtttgggggaagaggaagactgacggtcctcccaggagttcaggtgctgggcacagcggccctgggctgcctggtcaaggactacttcctacgtcgtatctgagcgggctggcaaggcgcatagnnnn

SEQ ID NO: 199580 - DNA, 219 bp, Homo sapiens
  misc_feature: GYAE6OF01EWWFV.12.55.E11.1.454.CMB.1.raw
  modified_base (218)..(219): a, c, t, g, unknown or other
  misc_feature (218)..(219): n is a, c, g, or t
tcagatacgacgtacacgaccggtgctcgatttagcactcgcacgttgggtttgggggaagaggaagactgacggtcctcccaggagttcaggtgctgggcaccgtgggcatggggaggtgtgtcacaagatttgggctctgggcacagcggccctgggctgcctggtcaaggactacttcctacgtcgtatctgagcgggctggcaaggcgcatagnn

SEQ ID NO: 199581 - DNA, 219 bp, Homo sapiens
  misc_feature: GYAE6OF01B3YQ9.12.55.E11.1.454.CMB.1.raw
  modified_base (173)..(219): a, c, t, g, unknown or other
  misc_feature (173)..(219): n is a, c, g, or t
tcagatacgacgtacacgaccggtgctcgatttagcactcgcacgttgggttgggggaagaggaagactgacggtcctcccagggagttcaggtgctgggcacagcggccctgggctgcctggtcaaggctacttcctagtcgtatctgagcgggctgggcaaggcgcatagnnnnnnnnnnnnnnnnnnnnnnnnnnnnnnnnnnnnnnnnnnnnnnn

SEQ ID NO: 199582 - DNA, 161 bp, Homo sapiens; identical to SEQ ID NO: 199555
  misc_feature: GYAE6OF01AGXQ2.12.55.E11.1.454.CMB.1.raw
  modified_base (159)..(161): a, c, t, g, unknown or other
  misc_feature (159)..(161): n is a, c, g, or t

SEQ ID NO: 199583 - DNA, 176 bp, Homo sapiens; identical to SEQ ID NO: 199568
  misc_feature: GYAE6OF01C0JL2.12.55.E11.1.454.CMB.1.raw
  modified_base (174)..(176): a, c, t, g, unknown or other
  misc_feature (174)..(176): n is a, c, g, or t

SEQ ID NO: 199584 - DNA, 262 bp, Homo sapiens
  misc_feature: GYAE6OF01EKUY3.12.55.E11.1.454.CMB.1.raw
  modified_base (258)..(262): a, c, t, g, unknown or other
  misc_feature (258)..(262): n is a, c, g, or t
tcagatacgacgtacacgaccggtgctcgatttagcactcgcacgttgggtttgggggaagaggaagactgacggtcctcccaggagttcaggtgctgggcaccctggtcactgtctcctcggcttccaccaagggcccatcggtcttccccctggcgccctgctccaggagcacctctgggggcacagcggccctgggctgcctggtcaaggactacttcctacgtcgtatctgagcgggctggcaaggcgcatagnnnnn

SEQ ID NO: 199585 - DNA, 222 bp, Homo sapiens
  misc_feature: GYAE6OF01DMBZ5.12.55.E11.1.454.CMB.1.raw
  modified_base (217)..(222): a, c, t, g, unknown or other
  misc_feature (217)..(222): n is a, c, g, or t
tcagatacgacgtacacgaccggtgctcgatttagcactcgcacgttgggtttgggggaagaggaagactgacggtcctcccaggagttcaggtgctgggcaccgtgggcatggggaggtgtgtcacaagatttgggctctgggcacagcggccctgggctgcctggtcaaggctacttcctacgtcgtatctgagcgggctggcaaggcgcatagnnnnnn

SEQ ID NO: 199586 - DNA, 177 bp, Homo sapiens; identical to SEQ ID NO: 199579
  misc_feature: GYAE6OF01CO9B1.12.55.E11.1.454.CMB.1.raw
  modified_base (174)..(177): a, c, t, g, unknown or other
  misc_feature (174)..(177): n is a, c, g, or t

SEQ ID NO: 199587 - DNA, 545 bp, Homo sapiens
  misc_feature: GYAE6OF01ELTCW.12.55.E11.1.454.CMB.1.raw
  modified_base (297)..(297): a, c, t, g, unknown or other
  misc_feature (297)..(297): n is a, c, g, or t
  modified_base (353)..(353): a, c, t, g, unknown or other
  misc_feature (353)..(353): n is a, c, g, or t
tcagatacgacgtacacgaccggtgctcgatttagcactcgcacgttgggtttggggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccnccaggctccgagggaggggctgggaatgggtggcagttatatcatatgatgggaanctatcaatatacgcagattctgtgaagggccgactcaacctatctccaagagactaattccaagaaacaaactgtaatacttacaaaataaacagtactagagtacttagacgacacggctgtacttattactggtcgcgtaagacgtaactacgggtcgttacccttttcgtaggttactttcgagttccg

SEQ ID NO: 199588 - DNA, 174 bp, Homo sapiens
  misc_feature: GYAE6OF01A7DMF.12.55.E11.1.454.CMB.1.raw
  modified_base (159)..(174): a, c, t, g, unknown or other
  misc_feature (159)..(174): n is a, c, g, or t
tcagatacgacgtacacgaccggtgctcgatttagcactcgcacgttgggtttggggaggtgtgtcacaagatttgggctctgggcacagcggccctgggctgcctggtcaaggactacttccgagtgcgtctctgagcgggctggcaaggcgcatagnnnnnnnnnnnnnnnn

SEQ ID NO: 199589 - DNA, 158 bp, Homo sapiens
  misc_feature: GYAE6OF01CTP0X.12.55.E11.1.454.CMB.1.raw
  modified_base (156)..(158): a, c, t, g, unknown or other
  misc_feature (156)..(158): n is a, c, g, or t
tcagatacgacgtacacgaccggtgctcgatttagcactcgcacgttgggtttgggggaggtgtgtcacaagatttgggctctgggcacagcggccctgggctgcctggtcaaggactacttccgagtgcgtgagcgggctggcaaggcgcatagnnn

SEQ ID NO: 199590 - DNA, 161 bp, Homo sapiens; identical to SEQ ID NO: 199555
  misc_feature: GYAE6OF01C31E5.12.55.E11.1.454.CMB.1.raw
  modified_base (159)..(161): a, c, t, g, unknown or other
  misc_feature (159)..(161): n is a, c, g, or t

SEQ ID NO: 199591 - DNA, 261 bp, Homo sapiens
  misc_feature: GYAE6OF01C369W.12.55.E11.1.454.CMB.1.raw
  modified_base (258)..(261): a, c, t, g, unknown or other
  misc_feature (258)..(261): n is a, c, g, or t
tcagatacgacgtacacgaccggtgctcgatttagcactcgcacgttgggtttgggggaagaggaagactgacggtcctcccaggagttcaggtgctgggcaccctggtcactgtctcctcggcttccaccaagggcccatcggtcttccccctggcgccctgctccaggagcacctctgggggcacagcggccctgggctgcctggtcaaggactacttcctacgtcgtatctgagcgggctggcaaggcgcatagnnnn

SEQ ID NO: 199592 - DNA, 225 bp, Homo sapiens
  misc_feature: GYAE6OF01C4XYN.12.55.E11.1.454.CMB.1.raw
  modified_base (219)..(225): a, c, t, g, unknown or other
  misc_feature (219)..(225): n is a, c, g, or t
tcagatacgacgtacacgaccggtgctcgatttagcactcgcacgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctacgtcgtatctgagcgggctggcaaggcgcatagnnnnnnn

SEQ ID NO: 199593 - DNA, 175 bp, Homo sapiens; identical to SEQ ID NO: 199558
  misc_feature: GYAE6OF01B7CC9.12.55.E11.1.454.CMB.1.raw
  modified_base (174)..(175): a, c, t, g, unknown or other
  misc_feature (174)..(175): n is a, c, g, or t

SEQ ID NO: 199594 - DNA, 223 bp, Homo sapiens
  misc_feature: GYAE6OF01DV18H.12.55.E11.1.454.CMB.1.raw
  modified_base (219)..(223): a, c, t, g, unknown or other
  misc_feature (219)..(223): n is a, c, g, or t
tcagatacgacgtacacgaccggtgctcgatttagcactcgcacgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctacgtcgtatctgagcgggctggcaaggcgcatagnnnnn

SEQ ID NO: 199595 - DNA, 666 bp, Homo sapiens
  misc_feature: GYAE6OF01D1C2N.12.55.E11.1.454.CMB.1.raw
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
  modified_base (393)..(393): a, c, t, g, unknown or other
  misc_feature (393)..(393): n is a, c, g, or t
  modified_base (641)..(641): a, c, t, g, unknown or other
  misc_feature (641)..(641): n is a, c, g, or t
  modified_base (657)..(657): a, c, t, g, unknown or other
  misc_feature (657)..(657): n is a, c, g, or t
tcagatacgacgtacacgaccggtgctcgatttagcactcgcacgttgggtttggggagacgagcccagcactggaagtcgccggtgtttccattcggtgatcatcactgaacacagaggactcaccatggagtttgggctgagctgggttttcctcgttgcttcttttaagaggtgtccagtgtcagatgcagctggtggagtcgtggggggaggcgtggtccggcctggggaccgtccctgaccactcctcctgtgcagccgctggacttccaccttacccagttatgctatcgcaccgtggggtcccncaggcctccggaggggaggggctagggatggggtgctagttanatcatagtgatggaanctatacaaattatacgntaagtnttacgtggtaggaacggggccctaactccgaacctatccctaccgaaggaactaaactaaccttacccaaagtaaaaccctaaaacgttgttaaacttacctttaaacaaaaactaaaaccgtcggtttaaccgtaagtaaacggttacgtttaacgggaacgggtaaccaccgggtcttaagggttcttaacgttacgtgtacggtacgaggtaacgtaccgttacgggtactttaccgttttaggnggttttaactttcggngtttcccgg

SEQ ID NO: 199596 - DNA, 235 bp, Homo sapiens
  misc_feature: GYAE6OF01CWZ27.12.55.E11.1.454.CMB.1.raw
  modified_base (218)..(235): a, c, t, g, unknown or other
  misc_feature (218)..(235): n is a, c, g, or t
tcagatacgacgtacacgaccggtgctcgatttagcactcgcacgttgggtttggggggaagaggaagactgacggtcctcccaggagttcaggtgctgggcaccgtgggcatggggaggtgtgtcacaagatttgggctctgggcacagcggccctgggctgcctggtcaaggctacttcctacgtcgtatctgagcgggctggcaaggcgcatagnnnnnnnnnnnnnnnnnn

SEQ ID NO: 199597 - DNA, 220 bp, Homo sapiens
  misc_feature: GYAE6OF01CIVO1.12.55.E11.1.454.CMB.1.raw
  modified_base (219)..(220): a, c, t, g, unknown or other
  misc_feature (219)..(220): n is a, c, g, or t
tcagatacgacgtacacgaccggtgctcgatttagcactcgcacgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctacgtcgtatctgagcgggctggcaaggcgcatagnn

SEQ ID NO: 199598 - DNA, 162 bp, Homo sapiens
  misc_feature: GYAE6OF01D5ATP.12.55.E11.1.454.CMB.1.raw
  modified_base (154)..(154): a, c, t, g, unknown or other
  misc_feature (154)..(154): n is a, c, g, or t
  modified_base (160)..(162): a, c, t, g, unknown or other
  misc_feature (160)..(162): n is a, c, g, or t
tcagatacgacgtacacgaccggtgctcgatttagcactcgcacgttgggtttgggggaggtgtgtcacaagatttgggctctgggcacagcggccctgggctgcctggtcaaggactacttccgagtgcgtctctgagcgggctggcaaggcncatagnnn

SEQ ID NO: 199599 - DNA, 224 bp, Homo sapiens
  misc_feature: GYAE6OF01BZ02F.12.55.E11.1.454.CMB.1.raw
  modified_base (221)..(224): a, c, t, g, unknown or other
  misc_feature (221)..(224): n is a, c, g, or t
tcagatacgacgtacacgaccggtgctcgatttagcactcgcacgttgggtttgggggaagaggaagactgacggtcctcccaggagttcaggtgctgggcaccgtgggcagtgggggaggtgtgtcacaagtatttgggctctgggcacagcggccctgggctgcctggtcaaggactacttcctacgtcgtatctgagcgggctggcaaggcgcatagnnnn

SEQ ID NO: 199600 - DNA, 208 bp, Homo sapiens
  misc_feature: GYAE6OF01DW6M8.12.55.E11.1.454.CMB.1.raw
  modified_base (205)..(208): a, c, t, g, unknown or other
  misc_feature (205)..(208): n is a, c, g, or t
tcagatacgacgtacacgaccggtgctcgatttagcactcgcacgttgggtttgggggaggtgtgtcacaagatttgggctctgggcaccgtgggcagtgggggagtgtgtcacaagatttgggctctgggcacagcggccctgggctgcctggtcaaggactacttcctacgtcgtatctgagcgggctggcaaggcgcatagnnnn

SEQ ID NO: 199601 - DNA, 199 bp, Homo sapiens
  misc_feature: GYAE6OF01BBKH2.12.55.E11.1.454.CMB.1.raw
  modified_base (175)..(199): a, c, t, g, unknown or other
  misc_feature (175)..(199): n is a, c, g, or t
tcagatacgacgtacacgaccggtgctcgatttagcactcgcacgttgggtttggggggaagaggaagactgacggtcctcccaggagttcaggtcgctgggcacagcggccctgggctgcctggtcaaggctacttcctacgtcgtatctgagcgggctggcaaggcgcatagnnnnnnnnnnnnnnnnnnnnnnnnn

SEQ ID NO: 199602 - DNA, 222 bp, Homo sapiens
  misc_feature: GYAE6OF01D8TS6.12.55.E11.1.454.CMB.1.raw
  modified_base (219)..(222): a, c, t, g, unknown or other
  misc_feature (219)..(222): n is a, c, g, or t
tcagatacgacgtacacgaccggtgctcgatttagcactcgcacgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctacgtcgtatctgagcgggctggcaaggcgcatagnnnn

SEQ ID NO: 199603 - DNA, 224 bp, Homo sapiens
  misc_feature: GYAE6OF01DJG8Z.12.55.E11.1.454.CMB.1.raw
  modified_base (221)..(224): a, c, t, g, unknown or other
  misc_feature (221)..(224): n is a, c, g, or t
tcagatacgacgtacacgaccggtgctcgatttagcactcgcacgttgggtttggggggaagaggaagactgacggtcctcccaggagttcaggtgctgggcaccgtgggcagtgggggaggtgtgtcacaagatttgggctctgggcacagcggccctgggctgcctggtcaaggactacttcctacgtcgtatctgagcgggctggcaaggcgcatagnnnn

SEQ ID NO: 199604 - DNA, 162 bp, Homo sapiens
  misc_feature: GYAE6OF01EFN7Z.12.55.E11.1.454.CMB.1.raw
  modified_base (160)..(162): a, c, t, g, unknown or other
  misc_feature (160)..(162): n is a, c, g, or t
tcagatacgacgtacacgaccggtgctcgatttagcactcgcacgttgggtttgggggaggtgtgtcacaagatttgggctctgggcacagcggccctgggctgcctggtcaaggactacttccgagtgcgtctctgagcgggctggcaaggcgcatagnnn

SEQ ID NO: 199605 - DNA, 782 bp, Homo sapiens
  misc_feature: GYAE6OF01D7CE2.12.55.E11.1.454.CMB.1.raw
  modified_base (58)..(58): a, c, t, g, unknown or other
  misc_feature (58)..(58): n is a, c, g, or t
tcagatacgacgtacacgaccggtgctcgatttagcactcgcacgttgggttgggganacgagcccagcactggaagtcgccggtgttccattcggtgatcatcactgaacacagacgactcaccatggagtttgggctgagtctgggttttcctcgttgcttacttttaagaggtgtccagtgtcagtatcgcagcgtggtgacgtcggtagggggagccgtggtccggccgtggggaccctcctgactacgtctcctgtcgacgacgccgctaggtacttaccgaacccttaacccgagttactcgacttaacgcgacctacggtcgggttacccaccgtacgggtcctacccgggaaggggtacgggtccttagggaacggttcggggtacgtaccgttagttaactacgtccgtaagttacgtaggaacggttacggaacgtacttagtaacgtaaacgttaaccgttcccggaactacggttaatttcccggtagggtaacggtaaccgggtccctaacgttacccgaactaggtttaccccacggaaagaaccgtaaacttaaccgtaaccgtaaagtaaaaaccgtacttacgtaactaaccctaaacgtaaaaccttaagacggttaccgagaaaccgttaccgtagggaacccgtaccgacgggttactccgtttaaacggttaatccgttcggagttaccggaacggtgttaaacccgggttgttacccgttaacgtttggggaacttttcccgtaagccgtttaccccggg

SEQ ID NO: 199606 - DNA, 301 bp, Homo sapiens
  misc_feature: GYAE6OF01DXY51.12.55.E11.1.454.CMB.1.raw
  modified_base (255)..(255): a, c, t, g, unknown or other
  misc_feature (255)..(255): n is a, c, g, or t
  modified_base (284)..(301): a, c, t, g, unknown or other
  misc_feature (284)..(301): n is a, c, g, or t
tcagatacgacgtacacgaccggtgctcgatttagcactcgcacgttgggtttgggggggaagaggaagactgacggtcctcccaggagttcaggtgctgggcaccctggtcactgtctcctcggcttccaccagggcccatcggtcttccccctggccgccctgctccgaggacgccacctcggcgggggccacacggccggcccgtggggcctcggccgtggtacaaggtaccttacttcctacgtcgtatcnggacgcgggctaggcgaaggcgacagagnnnnnnnnnnnnnnnnnn

SEQ ID NO: 199607 - DNA, 221 bp, Homo sapiens
  misc_feature: GYAE6OF01DULW9.12.55.E11.1.454.CMB.1.raw
  modified_base (218)..(221): a, c, t, g, unknown or other
  misc_feature (218)..(221): n is a, c, g, or t
tcagatacgacgtacacgaccggtgctcgatttagcactcgcacgttgggtttgggggaagaggaagactgacggtcctcccaggagttcaggtgctgggcaccgtgggcatggggaggtgtgtcacaagatttgggctctgggcacagcggccctgggctgcctggtcaaggactacttcctacgtcgtatctgagcgggctggcaaggcgcatagnnnn

SEQ ID NO: 199608 - DNA, 177 bp, Homo sapiens
  misc_feature: GYAE6OF01B8ZHX.12.55.E11.1.454.CMB.1.raw
  modified_base (174)..(177): a, c, t, g, unknown or other
  misc_feature (174)..(177): n is a, c, g, or t
tcagatacgacgtacacgaccggtgctcgatttagcactcgcacgttgggtttggggggaagaggaagactgacggtcctcccaggagttcaggtgctgggcacagcggccctgggctgcctggtcaaggactacttcctacgtcgtatctgagcggctggcaaggcgcatagnnnn

SEQ ID NO: 199609 - DNA, 794 bp, Homo sapiens
  misc_feature: GYAE6OF01EZCSI.12.55.E11.1.454.CMB.1.raw
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (304)..(304): a, c, t, g, unknown or other
  misc_feature (304)..(304): n is a, c, g, or t
tcagatacgacgtacacgaccggtgctcgatttagcactcgcacgttgggtttgggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtcgtgggggagcgtggtccgctgggactcctgacnctctcctgtcgcagccgntggacttccaccttacccagtttatcgcttatcgcctacgtcgggtcccncaggcctaccggaaggggaggtcgtagggaacgttggggtcgtctaggtttaactacgtctaagttgtacgagttaacggggaataccttaatacgtaaactttacgttacggactaaaggttacgtttacggtgggttaacgggaaaccggggtccctaacccgttaccgaaccccgtaactttccccggtaaacccgaaagggtaacccgtaaaccgttaaaaccgtttaccccggaaaaaggttaaaaaacccttaaacccgtttggttaaacctttaaccgtttaaacccaaaaaagtttaaacgcgtttaaccgtaggtaaacgttaacctttaacggggaacgtaacggacccggtttaccgtaagtttaccttaaacgttacgtaggggttacgaaccgggagttaacggtacccgttaacgggtttaccgtttacccggtttttagtaaccgggttttagtttccccggtaagtttcccggg

SEQ ID NO: 199610 - DNA, 162 bp, Homo sapiens; identical to SEQ ID NO: 199604
  misc_feature: GYAE6OF01AWXIB.12.55.E11.1.454.CMB.1.raw
  modified_base (160)..(162): a, c, t, g, unknown or other
  misc_feature (160)..(162): n is a, c, g, or t

SEQ ID NO: 199611 - DNA, 262 bp, Homo sapiens
  misc_feature: GYAE6OF01BXMCJ.12.55.E11.1.454.CMB.1.raw
  modified_base (259)..(262): a, c, t, g, unknown or other
  misc_feature (259)..(262): n is a, c, g, or t
tcagatacgacgtacacgaccggtgctcgatttagcactcgcacgttgggtttggggggaagaggaagactgacggtcctcccaggagttcaggtgctgggcaccctggtcactgtctcctcggcttccaccaagggcccatcggtcttccccctggcgccctgctccaggagcacctctgggggcacagcggccctgggctgcctggtcaaggactacttcctacgtcgtatctgagcgggctggcaaggcgcatagnnnn

SEQ ID NO: 199612 - DNA, 260 bp, Homo sapiens
  misc_feature: GYAE6OF01E1MDF.12.55.E11.1.454.CMB.1.raw
  modified_base (257)..(260): a, c, t, g, unknown or other
  misc_feature (257)..(260): n is a, c, g, or t
tcagatacgacgtacacgaccggtgctcgatttagcactcgcacgttgggtttgggggaagaggaagactgacggtcctcccaggagttcaggtgctgggcaccctggtcactgtctcctcggcttccaccaagggcccatcggtcttcccctggcgccctgctccaggagcacctctgggggcacagcggccctgggctgcctggtcaaggactacttcctacgtcgtatctgagcgggctggcaaggcgcatagnnnn

SEQ ID NO: 199613 - DNA, 219 bp, Homo sapiens
  misc_feature: GYAE6OF01D9WJB.12.55.E11.1.454.CMB.1.raw
  modified_base (117)..(117): a, c, t, g, unknown or other
  misc_feature (117)..(117): n is a, c, g, or t
  modified_base (166)..(166): a, c, t, g, unknown or other
  misc_feature (166)..(166): n is a, c, g, or t
  modified_base (171)..(219): a, c, t, g, unknown or other
  misc_feature (171)..(219): n is a, c, g, or t
tcagatacgacgtacacgaccggtgctcgatttagcactcgcacgttgggtttggggggaagaggaagactgacggtcctcccaggagttcaggtgctgggcacagcgccctggctncctggtcaaggactactcctacgtcgtatctggagcggctggcaaggcnatagnnnnnnnnnnnnnnnnnnnnnnnnnnnnnnnnnnnnnnnnnnnnnnnnn

SEQ ID NO: 199614 - DNA, 163 bp, Homo sapiens
  misc_feature: GYAE6OF01A0362.12.55.E11.1.454.CMB.1.raw
  modified_base (160)..(163): a, c, t, g, unknown or other
  misc_feature (160)..(163): n is a, c, g, or t
tcagatacgacgtacacgaccggtgctcgatttagcactcgcacgttgggtttgggggaggtgtgtcacaagatttgggctctgggcacagcggccctgggctgcctggtcaaggactacttccgagtgcgtctctgagcgggctggcaaggcgcatagnnnn

SEQ ID NO: 199615 - DNA, 224 bp, Homo sapiens
  misc_feature: GYAE6OF01EW2FT.12.55.E11.1.454.CMB.1.raw
  modified_base (219)..(224): a, c, t, g, unknown or other
  misc_feature (219)..(224): n is a, c, g, or t
tcagatacgacgtacacgaccggtgctcgatttagcactcgcacgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctacgtcgtatctgagcgggctggcaaggcgcatagnnnnnn

SEQ ID NO: 199616 - DNA, 883 bp, Homo sapiens
  misc_feature: GYAE6OF01DBH2N.12.55.E11.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
  modified_base (863)..(863): a, c, t, g, unknown or other
  misc_feature (863)..(863): n is a, c, g, or t
tcagatacgacgtacacgaccggtgctcgatttagcactcgcacgttgggtttggggagacgagcccagcactggaagtcgccggtgtttccattcggtgatcatcactgaacacagagactcacatggtagttgggctgagtcgttgggttttccctcggttgtcctttagtttaaaggnggtcgtccgtagttcgtanagtatcgcctagtcgttgggtaggtaggtcgggtagggggacgtcggtcgggtaccggtcgtcgggacctcccgtgaacctccttctcgtagtcgacgcgccgtacgttacggtaccttcctacccttaacgtagttacgtcgtctacgtcgacgtccggttacggggccctaccggaccggtcggtaccgggaaggggtacgggtcgtaaaggggtcggtttacggggccgttaaacgttaaggttacttaaaccgtaggttaaggttaacggttaacggaagggtttaaaccgggaaattaacccggtttaaagttaacctttaaaacgtttaaccgggaccgtaattaaaccgggttttgtttacccggggtaaggggaaccggggttaaacccggccccgtttaaaccgacccttacccgttaacccgtaacgtaaccgtaaaccggtaaacggtaacccttaaagttaaacccgaaaacccggttaaataaacctttacggtaaacctaacgtaaacgtaaagtactacgtacgtacgtaacgtaggtaaccgagtaaccggtgttccgtaagtttcctacgttagtaaccgggcggtacgtaaaggtcccgttaaccggtttaggtttacccgttcggttttacttaaccggggttnttaccgtacgtttcccgggg

SEQ ID NO: 199617 - DNA, 268 bp, Homo sapiens
  misc_feature: GYAE6OF01B55Y8.12.55.E11.1.454.CMB.1.raw
  modified_base (263)..(268): a, c, t, g, unknown or other
  misc_feature (263)..(268): n is a, c, g, or t
tcagatacgacgtacacgaccggtgctcgatttagcactcgcacgttgggtttgggggaagaggaagactgacggtcctcccaggagttcaggtgctgggcaccctggtcactgtctcctcggcttccaccaaggcccatcggtcttcccctggcgccctgctccaggagccacctcgtgggggcacagccggccctggggctgccgtggtcaaggactacttccgtacgtcgtatctgaggcgggctggcaaggcgcatagnnnnnn

SEQ ID NO: 199618 - DNA, 205 bp, Homo sapiens
  misc_feature: GYAE6OF01C4CUL.12.55.E11.1.454.CMB.1.raw
  modified_base (176)..(205): a, c, t, g, unknown or other
  misc_feature (176)..(205): n is a, c, g, or t
tcagatacgacgtacacgaccggtgctcgatttagcactcgcacgttgggtttggggggaagaggaagactgacggtcctcccaggagttcaggtgctgggcacagcggccctgagctgcctggtcaaggacctcttctacgtcgtatctgagcgggctggcaaggcgtacatagnnnnnnnnnnnnnnnnnnnnnnnnnnnnnn

SEQ ID NO: 199619 - DNA, 332 bp, Homo sapiens
  misc_feature: GYAE6OF01C46KQ.12.55.E11.1.454.CMB.1.raw
  modified_base (314)..(332): a, c, t, g, unknown or other
  misc_feature (314)..(332): n is a, c, g, or t
tcagatacgacgtacacgaccggtgctcgatttagcactcgcacgttgggttgggggaagaggaagactggacggtcctcccaggagttcaggtgctgggcaccctggtcactgtcctcctcggcttaccaccgaacgggcccatccggtccttcccccgtggccgccctcgcctacccgaggacgccacccgtcgtgggggcacgacgccggtcccgtgggccgtcgcccgtgggtacaacggtaccttacgttacccgtacggttacgtacgttcgtaggacggcggggcgtcggacgaggccgtagatagnnnnnnnnnnnnnnnnnnn

SEQ ID NO: 199620 - DNA, 173 bp, Homo sapiens
  misc_feature: GYAE6OF02I6628.12.55.E11.1.454.CMB.1.raw
  modified_base (172)..(173): a, c, t, g, unknown or other
  misc_feature (172)..(173): n is a, c, g, or t
tcagatacgacgtacacgaccggtgctcgatttagcactcgcacgttgggttggggaagaggaagactgacggtcctcccaggagttcaggtgctgggcacagcggccctgggctgcctggtcaaggactacttcctacgtcgtatctgagcgggctggcaaggcgcatagnn

SEQ ID NO: 199621 - DNA, 219 bp, Homo sapiens
  misc_feature: GYAE6OF02GSSM0.12.55.E11.1.454.CMB.1.raw
  modified_base (205)..(219): a, c, t, g, unknown or other
  misc_feature (205)..(219): n is a, c, g, or t
tcagatacgacgtacacgaccggtgctcgatttagcactcgcacgttgggtttgggggaggtgtgtcacaagatttgggctctgggcaccggtgggcatgggggaggtgtgtcacaagatttgggctctgggcacagcggccctgggctgcctggtcaaggctacttcctacgtcgtatctgagcgggctggcaaggcgcatagnnnnnnnnnnnnnnn

SEQ ID NO: 199622 - DNA, 175 bp, Homo sapiens; identical to SEQ ID NO: 199558
  misc_feature: GYAE6OF02HKW8H.12.55.E11.1.454.CMB.1.raw
  modified_base (174)..(175): a, c, t, g, unknown or other
  misc_feature (174)..(175): n is a, c, g, or t

SEQ ID NO: 199623 - DNA, 160 bp, Homo sapiens; identical to SEQ ID NO: 199560
  misc_feature: GYAE6OF02IUJ4F.12.55.E11.1.454.CMB.1.raw
  modified_base (159)..(160): a, c, t, g, unknown or other
  misc_feature (159)..(160): n is a, c, g, or t

SEQ ID NO: 199624 - DNA, 158 bp, Homo sapiens
  misc_feature: GYAE6OF02JSRHH.12.55.E11.1.454.CMB.1.raw
  modified_base (155)..(158): a, c, t, g, unknown or other
  misc_feature (155)..(158): n is a, c, g, or t
tcagatacgacgtacacgaccggtgctcgatttagcactcgcacgttggttgggaggtgtgtcacaagattgggctctgggcacagcggccctgggctgcctggtcaaggactacttccgagtgcgtctctgagcgggctggcaaggcgcatagnnnn

SEQ ID NO: 199625 - DNA, 218 bp, Homo sapiens
  misc_feature: GYAE6OF02GPKLC.12.55.E11.1.454.CMB.1.raw
  modified_base (217)..(218): a, c, t, g, unknown or other
  misc_feature (217)..(218): n is a, c, g, or t
tcagatacgacgtacacgaccggtgctcgatttagcactcgcacgttgggtttggggaagaggaagactgacggtcctcccaggagttcaggtgctgggcaccgtgggcatggggaggtgtgtcacaagatttgggctctgggcacagcggccctgggctgcctggtcaaggactacttcctacgtcgtatctgagcgggctggcaaggcgcatagnn

SEQ ID NO: 199626 - DNA, 161 bp, Homo sapiens; identical to SEQ ID NO: 199555
  misc_feature: GYAE6OF02GVSXA.12.55.E11.1.454.CMB.1.raw
  modified_base (159)..(161): a, c, t, g, unknown or other
  misc_feature (159)..(161): n is a, c, g, or t

SEQ ID NO: 199627 - DNA, 219 bp, Homo sapiens; identical to SEQ ID NO: 199580
  misc_feature: GYAE6OF02GLAT7.12.55.E11.1.454.CMB.1.raw
  modified_base (218)..(219): a, c, t, g, unknown or other
  misc_feature (218)..(219): n is a, c, g, or t

SEQ ID NO: 199628 - DNA, 206 bp, Homo sapiens; identical to SEQ ID NO: 199550
  misc_feature: GYAE6OF02JDFSQ.12.55.E11.1.454.CMB.1.raw
  modified_base (203)..(206): a, c, t, g, unknown or other
  misc_feature (203)..(206): n is a, c, g, or t

SEQ ID NO: 199629 - DNA, 148 bp, Homo sapiens
  misc_feature: GYAE6OF02FMWY9.12.55.E11.1.454.CMB.1.raw
  modified_base (137)..(148): a, c, t, g, unknown or other
  misc_feature (137)..(148): n is a, c, g, or t
tcagatacgacgtacacgaccggtgctcgatttagcactcgcacgttgggtttgggctctgggcacagcggccctgggctgcctggtcaaggactacttcctacgtcgtatctgagcgggctggcaaggcgcatagnnnnnnnnnnnn

SEQ ID NO: 199630 - DNA, 258 bp, Homo sapiens
  misc_feature: GYAE6OF02IUWZ6.12.55.E11.1.454.CMB.1.raw
  modified_base (257)..(258): a, c, t, g, unknown or other
  misc_feature (257)..(258): n is a, c, g, or t
tcagatacgacgtacacgaccggtgctcgatttagcactcgcacgttgggtttgggggaagaggaagactgacggtcctcccaggagttcaggtgctgggcaccctggtcactgtctcctcggcttccaccaagggcccatcggtcttcccctggcgccctgctccaggagcacctctgggggcacagcggccctgggctgcctggtcaaggactacttcctacgtcgtatctgagcgggctggcaaggcgcatagnn

SEQ ID NO: 199631 - DNA, 161 bp, Homo sapiens; identical to SEQ ID NO: 199555
  misc_feature: GYAE6OF02HDQWI.12.55.E11.1.454.CMB.1.raw
  modified_base (159)..(161): a, c, t, g, unknown or other
  misc_feature (159)..(161): n is a, c, g, or t

SEQ ID NO: 199632 - DNA, 226 bp, Homo sapiens
  misc_feature: GYAE6OF02GQIMC.12.55.E11.1.454.CMB.1.raw
  modified_base (218)..(226): a, c, t, g, unknown or other
  misc_feature (218)..(226): n is a, c, g, or t
tcagatacgacgtacacgaccggtgctcgatttagcactcgcacgttgggtttgggggaagaggaagactgacggtcctcccaggagttcaggtgctgggcaccgtgggcatggggaggtgtgtcacaagatttgggctctgggcacagcggccctgggctgcctggtcaaggactacttcctacgtcgtatctgagcgggctggcaaggcgcatagnnnnnnnnn

SEQ ID NO: 199633 - DNA, 161 bp, Homo sapiens; identical to SEQ ID NO: 199555
  misc_feature: GYAE6OF02FR30E.12.55.E11.1.454.CMB.1.raw
  modified_base (159)..(161): a, c, t, g, unknown or other
  misc_feature (159)..(161): n is a, c, g, or t

SEQ ID NO: 199634 - DNA, 177 bp, Homo sapiens; identical to SEQ ID NO: 199579
  misc_feature: GYAE6OF02HAUMY.12.55.E11.1.454.CMB.1.raw
  modified_base (174)..(177): a, c, t, g, unknown or other
  misc_feature (174)..(177): n is a, c, g, or t

SEQ ID NO: 199635 - DNA, 144 bp, Homo sapiens
  misc_feature: GYAE6OF02FOT27.12.55.E11.1.454.CMB.1.raw
  modified_base (137)..(144): a, c, t, g, unknown or other
  misc_feature (137)..(144): n is a, c, g, or t
tcagatacgacgtacacgaccggtgctcgatttagcactcgcacgttgggtttgggctctgggcacagcggccctgggctgcctggtcaaggactacttcctacgtcgtatctgagcgggctggcaaggcgcatagnnnnnnnn

SEQ ID NO: 199636 - DNA, 175 bp, Homo sapiens; identical to SEQ ID NO: 199558
  misc_feature: GYAE6OF02I8PYO.12.55.E11.1.454.CMB.1.raw
  modified_base (174)..(175): a, c, t, g, unknown or other
  misc_feature (174)..(175): n is a, c, g, or t

SEQ ID NO: 199637 - DNA, 174 bp, Homo sapiens; identical to SEQ ID NO: 199554
  misc_feature: GYAE6OF02HAQIB.12.55.E11.1.454.CMB.1.raw
  modified_base (174)..(174): a, c, t, g, unknown or other
  misc_feature (174)..(174): n is a, c, g, or t

SEQ ID NO: 199638 - DNA, 185 bp, Homo sapiens
  misc_feature: GYAE6OF02G53UJ.12.55.E11.1.454.CMB.1.raw
  modified_base (174)..(185): a, c, t, g, unknown or other
  misc_feature (174)..(185): n is a, c, g, or t
tcagatacgacgtacacgaccggtgctcgatttagcactcgcacgttgggtttgggggaagaggaagactgacggtcctcccaggagttcaggtgctgggcacagcggccctgggctgcctggtcaaggactacttcctacgtcgtatctgagcgggctggcaaggcgcatagnnnnnnnnnnnn

SEQ ID NO: 199639 - DNA, 518 bp, Homo sapiens
  misc_feature: GYAE6OF02HSAJ1.12.55.E11.1.454.CMB.1.raw
  modified_base (404)..(404): a, c, t, g, unknown or other
  misc_feature (404)..(404): n is a, c, g, or t
  modified_base (475)..(475): a, c, t, g, unknown or other
  misc_feature (475)..(475): n is a, c, g, or t
tcagatacgacgtacacgaccggtgctcgatttagcactcgcacgttgggtttggggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtcccgccaggctccgaggggaaggggctgggaatggggtggcagttatatcatatgatggaagctatcaatattacgcagattctgtgaagggccactcaccatctcaganacaattccaagaaacaactgtactcttacaaataaacagtactgagacttgaggacacgctgtctattacngtgcgagagactaggtcgtaccttttcgtggtatttcgattcg

SEQ ID NO: 199640 - DNA, 176 bp, Homo sapiens; identical to SEQ ID NO: 199568
  misc_feature: GYAE6OF02II9VA.12.55.E11.1.454.CMB.1.raw
  modified_base (174)..(176): a, c, t, g, unknown or other
  misc_feature (174)..(176): n is a, c, g, or t

SEQ ID NO: 199641 - DNA, 221 bp, Homo sapiens
  misc_feature: GYAE6OF02FJK5U.12.55.E11.1.454.CMB.1.raw
  modified_base (219)..(221): a, c, t, g, unknown or other
  misc_feature (219)..(221): n is a, c, g, or t
tcagatacgacgtacacgaccggtgctcgatttagcactcgcacgttgggtttgggggaagaggaagactgacggtcctcccaggagttcaggtgctgggcaccgtgggcatgggggaggtgtgtcacaagatttgggctctgggcacagcggccctgggctgcctggtcaaggactacttcctacgtcgtatctgagcgggctggcaaggcgcatagnnn

SEQ ID NO: 199642 - DNA, 174 bp, Homo sapiens; identical to SEQ ID NO: 199554
  misc_feature: GYAE6OF02HJC8R.12.55.E11.1.454.CMB.1.raw
  modified_base (174)..(174): a, c, t, g, unknown or other
  misc_feature (174)..(174): n is a, c, g, or t

SEQ ID NO: 199643 - DNA, 220 bp, Homo sapiens; identical to SEQ ID NO: 199597
  misc_feature: GYAE6OF02ID8DT.12.55.E11.1.454.CMB.1.raw
  modified_base (219)..(220): a, c, t, g, unknown or other
  misc_feature (219)..(220): n is a, c, g, or t

SEQ ID NO: 199644 - DNA, 227 bp, Homo sapiens
  misc_feature: GYAE6OF02H2GAC.12.55.E11.1.454.CMB.1.raw
  modified_base (220)..(227): a, c, t, g, unknown or other
  misc_feature (220)..(227): n is a, c, g, or t
tcagatacgacgtacacgaccggtgctcgatttagcactcgcacgttgggtttgggggaagaggaagactgacggtcctcccaggagttcaggtgctgggcaccgtgggcatgggggaggtgtgtcacaagatttgggctctgggcacagccggccctgggctgcctggtcaaggactacttcctacgtcgtatctgagcgggctggcaaggcgcatagnnnnnnnn

SEQ ID NO: 199645 - DNA, 222 bp, Homo sapiens
  misc_feature: GYAE6OF02I4JWV.12.55.E11.1.454.CMB.1.raw
  modified_base (219)..(222): a, c, t, g, unknown or other
  misc_feature (219)..(222): n is a, c, g, or t
tcagatacgacgtacacgaccggtgctcgatttagcactcgcacgttgggtttgggggaagaggaagactggcggtcctcccaggagttcaggtgctgggcaccgtgggcatgggggaggtgtgtcacaagatttgggctctgggcacagcggccctgggctgcctggtcaaggactacttcctacgtcgtatctgagcgggctggcaaggcgcatagnnnn

SEQ ID NO: 199646 - DNA, 225 bp, Homo sapiens
  misc_feature: GYAE6OF02HNL2T.12.55.E11.1.454.CMB.1.raw
  modified_base (205)..(225): a, c, t, g, unknown or other
  misc_feature (205)..(225): n is a, c, g, or t
tcagatacgacgtacacgaccggtgctcgatttagcactcgcacgttgggtttgggggaggtgtgtcacaagatttgggctctgggcaccgtgggcatgggggagtgtgtcacaagatttgggctctgggcacagcggccctgggctgcctggtcaaggactacttcctacgtcgtatctgagcgggctggcaaggcgcatagcnnnnnnnnnnnnnnnnnnnnn

SEQ ID NO: 199647 - DNA, 174 bp, Homo sapiens; identical to SEQ ID NO: 199554
  misc_feature: GYAE6OF02HDHSZ.12.55.E11.1.454.CMB.1.raw
  modified_base (174)..(174): a, c, t, g, unknown or other
  misc_feature (174)..(174): n is a, c, g, or t

SEQ ID NO: 199648 - DNA, 531 bp, Homo sapiens
  misc_feature: GYAE6OF02G6BL4.12.55.E11.1.454.CMB.1.raw
  modified_base (298)..(298): a, c, t, g, unknown or other
  misc_feature (298)..(298): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
tcagatacgacgtacacgaccggtgctcgatttagcactcgcacgttgggtttggggagacgagcccagcactggaagtcgccggtgtttccattcggtgatcatcactgaacacagaggactcaccatggagtttgggctgagctgggttttcctcgttgctcttttaagaggtgtccagtgtcagatgcagctggtggagtcgtgggggaggcgtggtccggcctgggacgtccctgacactctcctgtgcagccgctggattcaccttacccagttatgctatgcactgggtccncaggctccgagggagggctggatggggtgcagttatatcatatgatggaagctatcaatattacgcagattctgtagagggccactcaccntcncagagacatcaagaaacaactgtatacttacaaataacagtactagaagtacttaggagtacacggtcttgtacttagttactggttgacgtagagtaaccgttaggtcgttaccttttgtggttactttcgattccgg

SEQ ID NO: 199649 - DNA, 604 bp, Homo sapiens
  misc_feature: GYAE6OF02I3F60.12.55.E11.1.454.CMB.1.raw
  modified_base (155)..(155): a, c, t, g, unknown or other
  misc_feature (155)..(155): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (382)..(382): a, c, t, g, unknown or other
  misc_feature (382)..(382): n is a, c, g, or t
tcagatacgacgtacacgaccggtgctcgatttagcactcgcacgttgggtttggggagacgagcccagcactggaagtcgccggtgtttccattcggtgatcatcactgaacacagaggactcaccatggagtttgggctgagcgtggttttcncgttaggctcttttaagaggtgtccagtgtcagatgcagctggtggagtctgggggagcgtggtccggcctgggacgtccctgaccacgtctcctgtgcagccgctggattcacttacccagttacngctatgcacgtggtccnctaggcttaccgagggaagggctggaactggggtggcaggttatatcatatggatagggaatccgtaatcaagttattaccgnaggtatttcaggttagaacggggcctaacgtcgacctatctaccagacgaactaacgtcccgaagtaaacaacttgtaacttcctaacaaaataaccgagtacctgaacgtcttagagtaccacggtcgtagtaccttagttacctggtactaggaacgttagaccgtttaggtaccgtttaccgtttttaggacggttttactttaccggatttacccggg

SEQ ID NO: 199650 - DNA, 225 bp, Homo sapiens
  misc_feature: GYAE6OF02H7KUT.12.55.E11.1.454.CMB.1.raw
  modified_base (219)..(225): a, c, t, g, unknown or other
  misc_feature (219)..(225): n is a, c, g, or t
tcagatacgacgtacacgaccggtgctcgatttagcactcgcacgttgggtttggggggaagaggaagactgacggtcctcccaggagttcaggtgctgggcaccggtgggcatgggggaggtgtgtcacaagattttgggctctgggcacagcggccctgggctagcctggtcaaggctacttcctagtcgtatctgagcggctggcaggcgcatagnnnnnnn

SEQ ID NO: 199651 - DNA, 223 bp, Homo sapiens
  misc_feature: GYAE6OF02IOLJR.12.55.E11.1.454.CMB.1.raw
  modified_base (219)..(223): a, c, t, g, unknown or other
  misc_feature (219)..(223): n is a, c, g, or t
tcagatacgacgtacacgaccggtgctcgatttagcactcgcacgttgggtttggggggaagaggaagactgacggtcctcccaggagttcaggtgctgggcaccgtgggcatgggggaggtgtgtcacaagatttgggctctgggcacagcggccctgggctgcctggtcaaggactacttcctacgtcgtatctgagcggctggcaaggcgcatagnnnnn

SEQ ID NO: 199652 - DNA, 173 bp, Homo sapiens
  misc_feature: GYAE6OF02GSNJY.12.55.E11.1.454.CMB.1.raw
tcagatacgacgtacacgaccggtgctcgatttagcactcgcacgttgggtttgggggaagaggaagactgacggtcctcccaggagttcaggtgctgggcacagcggccctgggctgcctggtcaaggactacttcctacgtcgtatctgagcgggctggcaaggcgcatag

SEQ ID NO: 199653 - DNA, 261 bp, Homo sapiens
  misc_feature: GYAE6OF02H0Y54.12.55.E11.1.454.CMB.1.raw
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (203)..(205): a, c, t, g, unknown or other
  misc_feature (203)..(205): n is a, c, g, or t
  modified_base (207)..(261): a, c, t, g, unknown or other
  misc_feature (207)..(261): n is a, c, g, or t
tcagatacgacgtacacgaccggtgctcgatttagcactcgcacgtttggtttgggggaggtgtgtcacaagatttgggctctgggcaccgtgggcatgggggagtgtgtcacaagatttgggctctgggcacagcggccctgggctgcctggtcaaggactacttcctacgtcgtatctgagcgggntggcaaggcnatagnnncnnnnnnnnnnnnnnnnnnnnnnnnnnnnnnnnnnnnnnnnnnnnnnnnnnnnnnn

SEQ ID NO: 199654 - DNA, 240 bp, Homo sapiens
  misc_feature: GYAE6OF02HXEYV.12.55.E11.1.454.CMB.1.raw
  modified_base (211)..(211): a, c, t, g, unknown or other
  misc_feature (211)..(211): n is a, c, g, or t
  modified_base (216)..(240): a, c, t, g, unknown or other
  misc_feature (216)..(240): n is a, c, g, or t
tcagatacgacgtacacgaccggtgctcgattttagcactcgcacgttgggtttgggggaagaggaagactgacggtcctcccaggagttcaggtgctgggcaccgtgggcatgggggaggtgtgtcacaagatttgggctctggcacagcgccctgggctgcctggtcaaggctacttcctacgtcgtatctgagcgggctggcaaggcnatagnnnnnnnnnnnnnnnnnnnnnnnnn

SEQ ID NO: 199655 - DNA, 212 bp, Homo sapiens
  misc_feature: GYAE6OF02HVY8K.12.55.E11.1.454.CMB.1.raw
  modified_base (205)..(212): a, c, t, g, unknown or other
  misc_feature (205)..(212): n is a, c, g, or t
tcagatacgacgtacacgaccggtgctcgatttagcactcgcacgttgggtttgggggaggtgtgtcacaagatttgggctctgggcaccgtgggcatgggggaggtgtgtcacaagatttgggctctgggcacagcggccctgggctgcctggtcaaggactacttcctacgtcgtatctgagcgggctggcaaggcgcatagnnnnnnnn

SEQ ID NO: 199656 - DNA, 179 bp, Homo sapiens
  misc_feature: GYAE6OF02F7LF4.12.55.E11.1.454.CMB.1.raw
  modified_base (173)..(179): a, c, t, g, unknown or other
  misc_feature (173)..(179): n is a, c, g, or t
tcagatacgacgtacacgaccggtgctcgatttagcactcgcacgttgggtttgggggaagaggaagactgacggtcctcccaggagttcaggtgctgggcacagcggccctggctgcctggtcaaggactacttcctacgtcgtatctgagcgggctggcaaggcgcatagnnnnnnn

SEQ ID NO: 199657 - DNA, 257 bp, Homo sapiens
  misc_feature: GYAE6OF02GSZK6.12.55.E11.1.454.CMB.1.raw
  modified_base (133)..(133): a, c, t, g, unknown or other
  misc_feature (133)..(133): n is a, c, g, or t
  modified_base (214)..(214): a, c, t, g, unknown or other
  misc_feature (214)..(214): n is a, c, g, or t
  modified_base (220)..(224): a, c, t, g, unknown or other
  misc_feature (220)..(224): n is a, c, g, or t
  modified_base (226)..(257): a, c, t, g, unknown or other
  misc_feature (226)..(257): n is a, c, g, or t
tcagatacgacgtacacgaccggtgctcgatttagcactcgcacgttgggtttggggggaagaggaagactgacggtcctcccaggagttcaggtgctgggcaccgtgggcatgggggaggtgtgtcacaagntttgggctctgggcacagcggccctgggctgcctggtcaaggactacttcctacgtcgtatctgagcgggctggcaaggcncatagnnnnnannnnnnnnnnnnnnnnnnnnnnnnnnnnnnnn

SEQ ID NO: 199658 - DNA, 176 bp, Homo sapiens
  misc_feature: GYAE6OF02GT828.12.55.E11.1.454.CMB.1.raw
  modified_base (165)..(176): a, c, t, g, unknown or other
  misc_feature (165)..(176): n is a, c, g, or t
tcagatacgacgtacacgaccggtgctcgatttagcactcgcacgttgggtttgggggggggggagtgtgtcacaagatttgggctctgggcacagcggccctgggctgcctggtcaaggactacttccgagtgcgtctctgagcgggctggcaaggcgcatagnnnnnnnnnnnn

SEQ ID NO: 199659 - DNA, 773 bp, Homo sapiens
  misc_feature: GYAE6OF02IJ7JY.12.55.E11.1.454.CMB.1.raw
  modified_base (132)..(132): a, c, t, g, unknown or other
  misc_feature (132)..(132): n is a, c, g, or t
  modified_base (282)..(282): a, c, t, g, unknown or other
  misc_feature (282)..(282): n is a, c, g, or t
tcagatacgacgtacacgaccggtgctcgatttagcactcgcacgttgggtttggggagacgagcccagcactggaagtcgccggtgtttccattcggtgatcatcactgaacacagagactcaccagtggngtttgggctgagtccttgggtttttccctcgttgcttacttttaaggaggtgtccagttgtcagatgcagtcgtggtggagtcggtgggggagtcgtggtaccggctgggaccgtccctgacctacttcctccgtgtcgctaggcccgtntcggtacttccaccttaacccgtattactcgactatcgactacgtcgggtccccgacgcgtccggtacgggtaacgggggacggggtcggtagggtaaggtcgggggttggaccgttaggtttaacgtattacgtattaacgtaggtacgtaggaagtaccttagtaactaatacgttacacgtagtacttgtggacgggtaacggtaccgtaccgtaccgtaccagtccctaacgacgtaagtaaccttaaacgtaaccgaaacgaaaaccttaaaccgtacgttaacctttaacttaaaccaaaacgttaaccgtaagttaaccgttacggtaaacgtaacgttaccgggaactaaaccggtccgttacttaccggttattaacgtttccggtaggtacggtaacggaacggttaaacgtaccggttaaacggttttcccggtttaacgttttccggttagttttaaccgtttcccgtagtttcccggg

SEQ ID NO: 199660 - DNA, 176 bp, Homo sapiens
  misc_feature: GYAE6OF02IGY1R.12.55.E11.1.454.CMB.1.raw
  modified_base (171)..(176): a, c, t, g, unknown or other
  misc_feature (171)..(176): n is a, c, g, or t
tcagatacgacgtacacgaccggtgctcgatttagcactcgcacgttgggttgggggaagaggaagactgacggtcctccaggagttcaggtgctgggcacagcggccctgggctgcctggtcaaggctacttcctacgtcgtatctgagcgggctggcaaggcgcatagnnnnnn

SEQ ID NO: 199661 - DNA, 736 bp, Homo sapiens
  misc_feature: GYAE6OF02JOVQI.12.55.E11.1.454.CMB.1.raw
  modified_base (205)..(205): a, c, t, g, unknown or other
  misc_feature (205)..(205): n is a, c, g, or t
  modified_base (674)..(674): a, c, t, g, unknown or other
  misc_feature (674)..(674): n is a, c, g, or t
tcagatacgacgtacacgaccggtgctcgatttagcactcgcacgtttgggtttgggggagacgagcccagcactggaagtcgccggttgtttccattcggtgatcatcactgaacacagacggactcaccatggagtttgggctgagcttgggtttttcctcggttgcttacttttaagcggtcgtccaagttggtcagtatgnaggtccgttagggtggacgttcggtgggggggagtccgtcgggggtcccgtaccgtggggacctccccgtgacctacttccgtaccgtgtggcacggccgtctcggtactttcccgaccttacccgtagttactcgacttatcgactcggtccgggtcccgaccgagggcctaccgggtaaggggacgggtacttaggggaacggtgggggttaccggacttaacgggttactacgttcgaagttgtaacggagttcggaacgtccttaatactaagtacgttaacggctagttcttagccgggtaagaccgggtcctaccggtcaaccgtcgtaccaccgtagacgtaacgtactaacaaacgttaacctaacgttagttaccttaacgtaacctaaagtacccgttagccgttaaagtacccgtaaagttccgggaacgtacgacggtatttcgtactagtttacgngtaccggataagccggttaagtcggttacttacgtttcgaaggtttcccgtactgttaaccg

SEQ ID NO: 199662 - DNA, 194 bp, Homo sapiens
  misc_feature: GYAE6OF02F8FPH.12.55.E11.1.454.CMB.1.raw
  modified_base (175)..(194): a, c, t, g, unknown or other
  misc_feature (175)..(194): n is a, c, g, or t
tcagatacgacgtacacgaccggtgctcgatttagcactcgcacgttgggtttggggggaagaggaagactgacggtcctcccaggagttcaggtgctgggcacagcggccctgggctgcctggtcaaggactacttcctacgtcgtatctgagcgggctggcaaggcgcatagnnnnnnnnnnnnnnnnnnnn

SEQ ID NO: 199663 - DNA, 433 bp, Homo sapiens
  misc_feature: GYAE6OF01DYTHL.47.24.C02.1.454.CMB.1.raw
  modified_base (429)..(433): a, c, t, g, unknown or other
  misc_feature (429)..(433): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaggactacttcctacgtgagctctgagcgggctggcaaggcgcatagnnnnn

SEQ ID NO: 199664 - DNA, 435 bp, Homo sapiens
  misc_feature: GYAE6OF01BO52G.47.24.C02.1.454.CMB.1.raw
  modified_base (430)..(435): a, c, t, g, unknown or other
  misc_feature (430)..(435): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagctctgagcgggctggcaaggcgcatagnnnnnn

SEQ ID NO: 199665 - DNA, 435 bp, Homo sapiens
  misc_feature: GYAE6OF01EG4E1.47.24.C02.1.454.CMB.1.raw
  modified_base (429)..(435): a, c, t, g, unknown or other
  misc_feature (429)..(435): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctctggggcacagcggccctgggctgcctggtcaaggactacttcctacgtgagctctgagcgggctggcaaggcgcatagnnnnnnn

SEQ ID NO: 199666 - DNA, 436 bp, Homo sapiens
  misc_feature: GYAE6OF01A0ORT.47.24.C02.1.454.CMB.1.raw
  modified_base (427)..(427): a, c, t, g, unknown or other
  misc_feature (427)..(427): n is a, c, g, or t
  modified_base (432)..(436): a, c, t, g, unknown or other
  misc_feature (432)..(436): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggccccatcggtcttccccctggcaccctcctccaagagcacctctgggggcacagcggccctgggctgcctggtcaaggactacttcctacgtgagctctgagcgggctgggcaaggcgnatagnnnnn

SEQ ID NO: 199667 - DNA, 433 bp, Homo sapiens
  misc_feature: GYAE6OF01AIB9O.47.24.C02.1.454.CMB.1.raw
  modified_base (421)..(421): a, c, t, g, unknown or other
  misc_feature (421)..(421): n is a, c, g, or t
  modified_base (427)..(433): a, c, t, g, unknown or other
  misc_feature (427)..(433): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaaggcccatcggtctcccctggcgccctgctccaggagcacctccgagagcacagcggccctgggctgcctggtcaaggactacttcctacgtgagctctgagcgggctggcaaggcncatagnnnnnnn

SEQ ID NO: 199668 - DNA, 435 bp, Homo sapiens
  misc_feature: GYAE6OF01BTQVL.47.24.C02.1.454.CMB.1.raw
  modified_base (429)..(435): a, c, t, g, unknown or other
  misc_feature (429)..(435): n is a, c, g, or t
tcagagctcacgtacacgaccggtgctcgatttagtacagatcgttaggggaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttcccctggcgccctgctccaggagccacctccgagacgcacagcggccctgggctgcctggtcaaggctactcctacgtgagctctgagcgggctggcaaggcgcatagnnnnnnn

SEQ ID NO: 199669 - DNA, 441 bp, Homo sapiens
  misc_feature: GYAE6OF01AQ80Z.47.24.C02.1.454.CMB.1.raw
  modified_base (428)..(441): a, c, t, g, unknown or other
  misc_feature (428)..(441): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttcccctggcgccctgctccaggagcacctccgagagcacagcggccctgggctgcctggtcaaggactacttcctagtgagctctgagcgggctggcaaggcgcatagnnnnnnnnnnnnnn

SEQ ID NO: 199670 - DNA, 442 bp, Homo sapiens
  misc_feature: GYAE6OF01DMDEZ.47.24.C02.1.454.CMB.1.raw
  modified_base (432)..(442): a, c, t, g, unknown or other
  misc_feature (432)..(442): n is a, c, g, or t
tcagagctcacgtacacgaccggtgctcgatttagtacagatcgttaggggaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattatgtgcgagaggggcacctcggtccgcttatactaccactcctacttggacgtctggggcaaagggaccgcggtcaccgtctcctcagcctccaccaagggcccatcggtcttccccgtggccgccctgctccaggacgccacctccgagacgcacacgcggccctgggctgcctggtcaaggactactcctacgtgagctctgagcgggctggcaaggcgcatagnnnnnnnnnnn

SEQ ID NO: 199671 - DNA, 432 bp, Homo sapiens
  misc_feature: GYAE6OF01DVJFE.47.24.C02.1.454.CMB.1.raw
  modified_base (328)..(328): a, c, t, g, unknown or other
  misc_feature (328)..(328): n is a, c, g, or t
  modified_base (422)..(422): a, c, t, g, unknown or other
  misc_feature (422)..(422): n is a, c, g, or t
  modified_base (428)..(432): a, c, t, g, unknown or other
  misc_feature (428)..(432): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagagggcacctcggtccgcttattactaccactcctacttgacgtctgggcgaaaggaccgcggtcaccgtctcctcagcctccaccaagggcccactcggtcttccccctcggngcccctgctccaggagcacctccgagagcacagcggccctgggctgcctggtcaaggcttactcctacgtgagctctgacgcgggctgcaaggngcatgnnnnn

SEQ ID NO: 199672 - DNA, 438 bp, Homo sapiens
  misc_feature: GYAE6OF01EXPJF.47.24.C02.1.454.CMB.1.raw
  modified_base (430)..(438): a, c, t, g, unknown or other
  misc_feature (430)..(438): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctgggcaaagggaccgcggtcaccgtctcctcagcctccaccaagggcccatcggtcttccccctggcgccctgctccaggagcacctccgagacgcacagcggccctgggctgcctggtcaaggactacttcctacgtgagctctgagcgggctggcaaggcgcatagnnnnnnnnn

SEQ ID NO: 199673 - DNA, 438 bp, Homo sapiens
  misc_feature: GYAE6OF01C2UMX.47.24.C02.1.454.CMB.1.raw
  modified_base (426)..(426): a, c, t, g, unknown or other
  misc_feature (426)..(426): n is a, c, g, or t
  modified_base (432)..(438): a, c, t, g, unknown or other
  misc_feature (432)..(438): n is a, c, g, or t
tcagagctcacgtacacgaccggtgctcgatttagtacagatcgttgggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatccggtcttcccctggccgccctgctccaggacgcacctccgagagccacagcggccctgggctgcctggtcaaggcctacttcctacgtgagctctgagcgggctggcaaggcncatagnnnnnnn

SEQ ID NO: 199674 - DNA, 434 bp, Homo sapiens
  misc_feature: GYAE6OF01D822R.47.24.C02.1.454.CMB.1.raw
  modified_base (428)..(434): a, c, t, g, unknown or other
  misc_feature (428)..(434): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggctactcctatgtatactctgagcgggctggcaaggcgcatagnnnnnnn

SEQ ID NO: 199675 - DNA, 432 bp, Homo sapiens
  misc_feature: GYAE6OF01A9JTG.47.24.C02.1.454.CMB.1.raw
  modified_base (424)..(424): a, c, t, g, unknown or other
  misc_feature (424)..(424): n is a, c, g, or t
  modified_base (430)..(432): a, c, t, g, unknown or other
  misc_feature (430)..(432): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttcccctggcgccctgcctccaggagcacctccgagagcacgagcggccctgggctgcctggtcaaggctacttcctacgtgagctctgagcgggctggcaaggcncatagnnn

SEQ ID NO: 199676 - DNA, 437 bp, Homo sapiens
  misc_feature: GYAE6OF01BI1Z8.47.24.C02.1.454.CMB.1.raw
  modified_base (428)..(437): a, c, t, g, unknown or other
  misc_feature (428)..(437): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttcccctggcgccctgctccaggagcacctccgagagcacagcggccctgggctgcctggtcaaggctacttcctacgtgagctctgagcgggctggcaaggcgcatagnnnnnnnnnn

SEQ ID NO: 199677 - DNA, 551 bp, Homo sapiens
  misc_feature: GYAE6OF01DBYHH.47.24.C02.1.454.CMB.1.raw
  modified_base (516)..(551): a, c, t, g, unknown or other
  misc_feature (516)..(551): n is a, c, g, or t
tcagagctcacgtacacgaccggtgctcgatttagtacagatcgttagggaagggactggagtggattggctatgttcattccagtgggagcaccgactataacctctccctcaagggtcagtcaccatcttggcagacacgtccaagcaccaattctccctgaagctgacttctatgaccgctgcggacgcggccgtctattattggtgcgaggaggggcaccgtcggtccgtctttacgttacctaccacttcccttacgttcgggacgttcgtggggacaaacggggaccgcggtcaccgttctcctcacgtccctaccaccgaacgggcccaagtccggtccttccccccgtggcccgcccgtgcctccgacggacgccacctccggagacgcacgacgccggcctgggctcgccgtggtacaaggtaccttacgttcccgtaacgtcgaacgtctcgtaggacgggccgggtacgtacgggaaccgtaacgggccggacctaaagtcggcnnnnnnnnnnnnnnnnnnnnnnnnnnnnnnnnnnnn

SEQ ID NO: 199678 - DNA, 451 bp, Homo sapiens
  misc_feature: GYAE6OF01BZ45X.47.24.C02.1.454.CMB.1.raw
  modified_base (441)..(451): a, c, t, g, unknown or other
  misc_feature (441)..(451): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggccgccctgctccgaggacgcacctccgagcgcacacggcggcccgtgggcctgcctggtacaagggactacttcctatgtgagctcgtgagcgggctggcaaggcgcagtagnnnnnnnnnnn

SEQ ID NO: 199679 - DNA, 511 bp, Homo sapiens
  misc_feature: GYAE6OF01EC6AJ.47.24.C02.1.454.CMB.1.raw
  modified_base (492)..(511): a, c, t, g, unknown or other
  misc_feature (492)..(511): n is a, c, g, or t
tcagagctcacgtacacgaccggtgctcgatttagtacagatcgttaggggaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgaggaggggcaccgtcggtccgcttattacctaccacttcctacttggacgtcgtgggcaaagggaccgcggtcaccgtctcctcacgcctccaccaacgggcccatccggtccttcccccgtggccgcccctgcctccaggacgccacccgtccgagacgccacgacgccggccctggggcctcgccgtggtaccaaagggtaccttaccgttaccctacggtcgtacgtccttcgtcggagggccgggtctgggaccgaacgggccgactagtaggcnnnnnnnnnnnnnnnnnnnn

SEQ ID NO: 199680 - DNA, 532 bp, Homo sapiens
  misc_feature: GYAE6OF01DAWFA.47.24.C02.1.454.CMB.1.raw
  modified_base (356)..(356): a, c, t, g, unknown or other
  misc_feature (356)..(356): n is a, c, g, or t
  modified_base (496)..(496): a, c, t, g, unknown or other
  misc_feature (496)..(496): n is a, c, g, or t
  modified_base (499)..(532): a, c, t, g, unknown or other
  misc_feature (499)..(532): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgactttctatgaccgctgcggacgcggccgtctatattgtgcgagaggggcacctcggtccgcttatactaccactcctagtggacgtctgggcaaagggaccgcggtcacgtctcctcagcctccacaagggcccatcggtcttccccctaggccaccctcctaccaacgacgccaaccttccgnggggggccacacggccggccccgtggggcctgtcccgtggtaccgaaacggaccttaaccttccgtaaccggtgtaacggccgttcgtacggtaacggcggggtaccgtcggggacaaacggggccgacgaacttaaggncgnnnnnnnnnnnnnnnnnnnnnnnnnnnnnnnnnn

SEQ ID NO: 199681 - DNA, 477 bp, Homo sapiens
  misc_feature: GYAE6OF01BDBUG.47.24.C02.1.454.CMB.1.raw
  modified_base (456)..(456): a, c, t, g, unknown or other
  misc_feature (456)..(456): n is a, c, g, or t
  modified_base (458)..(477): a, c, t, g, unknown or other
  misc_feature (458)..(477): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtcaagcaccaattctccctgaagctgacttctatgaccgctgcggacgcggccgtctattattgtgcgagaggggcacctcggtccgcttattactaccactcctacttggacgtcgtggggcaaagggaccgcggtccaccgtctcctcagcctccaccaggcccatccggtccttcccccgtggccgccctgcctccgaggacgccacctccgagacgcacagccggccctgggctgccgtggtcaagggtacctacttccgtacgtgacgtctcgtgacggcgggctgggacgaagggcgacagtagcngnnnnnnnnnnnnnnnnnnnn

SEQ ID NO: 199682 - DNA, 623 bp, Homo sapiens
  misc_feature: GYAE6OF01CF5XF.47.24.C02.1.454.CMB.1.raw
  modified_base (235)..(235): a, c, t, g, unknown or other
  misc_feature (235)..(235): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (576)..(576): a, c, t, g, unknown or other
  misc_feature (576)..(576): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctagaagctgactttctatgaccgctgcggacgcggccgtctattatgtgcgagagggcaccgtcggtccgtnttattacctaccacttcctacttggacgtcggtagggacaaacgggccgtcggtccaccgtctcctcacgcctaccacgaacggcccagtccggtccttccccgnggcccncctcgcctccgaggtacnccgaccctcggacgagcctacacggccggcccgtgggcctacggcccgtagggtacccgaaacggtacctttaaccgttccgtaccggtggtacggtccgttcgtacgggtaccgggccgggtaccgtacgggaaccggtaacgggcccgaacgttaagacgggtcgcgtacgacgacgacgacgcgcgacgacgacgtagcgcgagacgcngcgacgcgacgcgacgcgcgacacgtacgtcgactacgctcgcgacg

SEQ ID NO: 199683 - DNA, 484 bp, Homo sapiens
  misc_feature: GYAE6OF01ARMYY.47.24.C02.1.454.CMB.1.raw
  modified_base (324)..(324): a, c, t, g, unknown or other
  misc_feature (324)..(324): n is a, c, g, or t
  modified_base (361)..(361): a, c, t, g, unknown or other
  misc_feature (361)..(361): n is a, c, g, or t
  modified_base (455)..(456): a, c, t, g, unknown or other
  misc_feature (455)..(456): n is a, c, g, or t
  modified_base (458)..(484): a, c, t, g, unknown or other
  misc_feature (458)..(484): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttatactaccactcctacttggacgtctggggcaaaggggccgcggtcaccgtctcctcagcctccaccaagggcccatcggtcttccccnggccgccctgcctccaggagccacctccgagagcacnggccggcccctgggcctcgcctggtaccaaggtcctacttcccgtacgtgacgctcgtggacggcgggtctgggcgaaggccgactagtagganngnnnnnnnnnnnnnnnnnnnnnnnnnnn

SEQ ID NO: 199684 - DNA, 563 bp, Homo sapiens
  misc_feature: GYAE6OF01DY17D.47.24.C02.1.454.CMB.1.raw
  modified_base (359)..(359): a, c, t, g, unknown or other
  misc_feature (359)..(359): n is a, c, g, or t
  modified_base (514)..(514): a, c, t, g, unknown or other
  misc_feature (514)..(514): n is a, c, g, or t
  modified_base (522)..(523): a, c, t, g, unknown or other
  misc_feature (522)..(523): n is a, c, g, or t
  modified_base (526)..(526): a, c, t, g, unknown or other
  misc_feature (526)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (534)..(534): a, c, t, g, unknown or other
  misc_feature (534)..(534): n is a, c, g, or t
  modified_base (537)..(545): a, c, t, g, unknown or other
  misc_feature (537)..(545): n is a, c, g, or t
  modified_base (548)..(548): a, c, t, g, unknown or other
  misc_feature (548)..(548): n is a, c, g, or t
  modified_base (550)..(561): a, c, t, g, unknown or other
  misc_feature (550)..(561): n is a, c, g, or t
  modified_base (563)..(563): a, c, t, g, unknown or other
  misc_feature (563)..(563): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtcttattatgtgcgagaggggcacctcggtccgcttattaccaccactcctacttggacgtcgtgggacaaagggccgcggtcaccgtctcctcagccctccaccgaacgggccccagtccggtccttcccccgtggccctcccgtgccctaccgaggcnccgacctcgagacgccacgacgccggtcccgtgggcctcggccgtggtacgaaacggtacctttaccgttcccgtaacggtcgacgtcccgttacgtcgggaaccgggtccggggaccgttacgggaaccgaacgggccgtacggaacgttaggnccgatcgnncgngncncgcncannnnnnnnncgngnnnnnnnnnnnngn

SEQ ID NO: 199685 - DNA, 481 bp, Homo sapiens
  misc_feature: GYAE6OF01ANYMG.47.24.C02.1.454.CMB.1.raw
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
  modified_base (403)..(403): a, c, t, g, unknown or other
  misc_feature (403)..(403): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (452)..(481): a, c, t, g, unknown or other
  misc_feature (452)..(481): n is a, c, g, or t
tcagagctcacgtacacgaccggtgctcgatttagtacagatcgttgggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgaggaggggcacctcggtccncttattacctaccactcctaacttggacgtcgtgggcaaagggaccgcggtcaccgtctcctcagcctccaccgaggcccngtacggtcctccccngccgcctgctccaggcncacctcgagagcacagccggccctgggcctgccctggtcagggacttactccacggtnacgctcgtgacgcgggcgtcggacgaacgggcgtacgaacgtgnancgnnnnnnnnnnnnnnnnnnnnnnnnnnnnnn

SEQ ID NO: 199686 - DNA, 503 bp, Homo sapiens
  misc_feature: GYAE6OF01CLKHY.47.24.C02.1.454.CMB.1.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (331)..(331): a, c, t, g, unknown or other
  misc_feature (331)..(331): n is a, c, g, or t
  modified_base (426)..(426): a, c, t, g, unknown or other
  misc_feature (426)..(426): n is a, c, g, or t
  modified_base (478)..(478): a, c, t, g, unknown or other
  misc_feature (478)..(478): n is a, c, g, or t
  modified_base (480)..(503): a, c, t, g, unknown or other
  misc_feature (480)..(503): n is a, c, g, or t
tcagagctcacgtacacgaccggtgctcgatttagtacagatcgttagggaaagggactggagtggattggctatgttcattccagtgggagcaccgactataacctctccctcaagggtcagtcaccatcttggcagacacgtccaagcaccaattctccctgaagctgacttctatcgaccgctgcggacgcggccgtctattattgtgcgagngggcacctcggtccgntttatacctaccactcctacttggaccgtcgtggggacaaacgggccgcggtcaccgtctcctcagccctcaccacgggcccagtcgtcccgttccccnggcctaccctgctccaggcgccaccgccggaagcgaccgaccaggccggcccgtggccgtgccgtggtacacggaccttacgtccttacgtgacncttcgtacgaggtccgggacgtcggacgacggggtcccacgataagcagcangnnnnnnnnnnnnnnnnnnnnnnnn

SEQ ID NO: 199687 - DNA, 890 bp, Homo sapiens
  misc_feature: GYAE6OF01EY5JV.47.24.C02.1.454.CMB.1.raw
  modified_base (131)..(131): a, c, t, g, unknown or other
  misc_feature (131)..(131): n is a, c, g, or t
  modified_base (139)..(139): a, c, t, g, unknown or other
  misc_feature (139)..(139): n is a, c, g, or t
  modified_base (164)..(164): a, c, t, g, unknown or other
  misc_feature (164)..(164): n is a, c, g, or t
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
  modified_base (837)..(837): a, c, t, g, unknown or other
  misc_feature (837)..(837): n is a, c, g, or t
  modified_base (842)..(843): a, c, t, g, unknown or other
  misc_feature (842)..(843): n is a, c, g, or t
  modified_base (856)..(856): a, c, t, g, unknown or other
  misc_feature (856)..(856): n is a, c, g, or t
  modified_base (859)..(859): a, c, t, g, unknown or other
  misc_feature (859)..(859): n is a, c, g, or t
  modified_base (864)..(864): a, c, t, g, unknown or other
  misc_feature (864)..(864): n is a, c, g, or t
  modified_base (866)..(867): a, c, t, g, unknown or other
  misc_feature (866)..(867): n is a, c, g, or t
  modified_base (870)..(871): a, c, t, g, unknown or other
  misc_feature (870)..(871): n is a, c, g, or t
  modified_base (875)..(875): a, c, t, g, unknown or other
  misc_feature (875)..(875): n is a, c, g, or t
  modified_base (877)..(878): a, c, t, g, unknown or other
  misc_feature (877)..(878): n is a, c, g, or t
  modified_base (880)..(880): a, c, t, g, unknown or other
  misc_feature (880)..(880): n is a, c, g, or t
  modified_base (882)..(883): a, c, t, g, unknown or other
  misc_feature (882)..(883): n is a, c, g, or t
  modified_base (885)..(885): a, c, t, g, unknown or other
  misc_feature (885)..(885): n is a, c, g, or t
  modified_base (890)..(890): a, c, t, g, unknown or other
  misc_feature (890)..(890): n is a, c, g, or t
tcagagctcacgtacacgaccggtgctcgatttagtacagatcgttagggaaagggacgtggagtggattggctatgttcagttccagtgggagcaccgctataacctctccctcgaagggtcgatcaccntcgtgcanacgcgtccaagccacctaacttccnccgtagaactcgtacgttaccttgtacnccggaccgtctacgggccgaccggtccggtacccttntttaacgtttacggtttcggacgggaccggtaggggaccgggttccctacccggttccgggttacccttaattttacgtaaacccctacccgttaccgtttacccgttaacggtcgggtacccggtttggggttaaccggggaaacccgtaaacccggggttcccctaccgtaccggttcctacccgttcgaccctccccgttaaaccgaaccccggggtaccggtacccctttacgggttccggtttccccccgtttcccggaacccggttaccccctaccccgtttcccccggaaagtaacccggtcggtaacccctttccggggtaccgggtaccgggggacctaaccgggtcccggtttccccgggggtaccccggttaggttcccggggtaaccccgtttacccggtagggtttaaacccccggtaaaacccgggttttccctttaacccgggtttttaaccccggggaggttaaccgggttcccctaaccgggttttccgaacgggggttaacccgggtcccgggggtttaaccgaccggggaaaccgggtttacggccccgggtaattaacgtcggaacgttcacgtagtgatcgctgtgngtacnncgttcatggactncgntcgancnngcnncgcngnncncnncngtgtn

SEQ ID NO: 199688 - DNA, 596 bp, Homo sapiens
  misc_feature: GYAE6OF01C4CMH.47.24.C02.1.454.CMB.1.raw
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
  modified_base (543)..(543): a, c, t, g, unknown or other
  misc_feature (543)..(543): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (558)..(558): a, c, t, g, unknown or other
  misc_feature (558)..(558): n is a, c, g, or t
  modified_base (561)..(561): a, c, t, g, unknown or other
  misc_feature (561)..(561): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (576)..(577): a, c, t, g, unknown or other
  misc_feature (576)..(577): n is a, c, g, or t
  modified_base (581)..(583): a, c, t, g, unknown or other
  misc_feature (581)..(583): n is a, c, g, or t
  modified_base (585)..(587): a, c, t, g, unknown or other
  misc_feature (585)..(587): n is a, c, g, or t
  modified_base (590)..(594): a, c, t, g, unknown or other
  misc_feature (590)..(594): n is a, c, g, or t
  modified_base (596)..(596): a, c, t, g, unknown or other
  misc_feature (596)..(596): n is a, c, g, or t
tcagagctcacgtacacgaccggtgctcgatttagtacagatcgttagggaaagggactggagtggattggctatgttcattccagtgggagcaccgactataacctctccctcaagggtcgagtccaccatcttggcagacacgtccaagcaccaattcctccctgaagctgactttctatcgaccgctgccggacgccggccgtctattagttgtgcgaggaggggccaccgttccggtccgtactttacttacctacctaccttccttacgttggacgttcgtggggacaaacgggccgcggtcaccgtctccncacgccctccaccgacggcccagttccgtcctccccgnggccncccgtgcctccgaggcgccacccgtcggagacgaccacgacggcccggtacccgtgggccttcggccgttaggtaacccaacggttaacccttccggtttaccctacggtacgacgtccgttcggtacgggaaccgggccgggttacgtacggaccggtaacggccgtacgtaaggttacgcngctagcancnncacncgngcgngncnngcagcnncgcnnncnnngtnnnnngn

SEQ ID NO: 199689 - DNA, 434 bp, Homo sapiens
  misc_feature: GYAE6OF02FQTNE.47.24.C02.1.454.CMB.1.raw
  modified_base (429)..(434): a, c, t, g, unknown or other
  misc_feature (429)..(434): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaaggcccatcggtcttccccctggcgccctgctccaggagcacctccgagagcacagcggccctgggctgcctggtcaaggactacttcctacgtgagctctgagcgggctggcaaggcgcatagnnnnnn

SEQ ID NO: 199690 - DNA, 437 bp, Homo sapiens
  misc_feature: GYAE6OF02F4H3D.47.24.C02.1.454.CMB.1.raw
  modified_base (424)..(424): a, c, t, g, unknown or other
  misc_feature (424)..(424): n is a, c, g, or t
  modified_base (430)..(437): a, c, t, g, unknown or other
  misc_feature (430)..(437): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggtcgtctattattgtgcgagaggggcacctcggtccgcttattactaccactcctacttggacgtctggggcaaagggaccgcggtcaccgtctcctcagcctccaccaaggcccatcggtcttccccctggcgccctgctccaggagcacctccgagagcacagcggccctgggctgcctggtcaaggactacttcctatgtatactctgagcgggctggcaagggcncatagnnnnnnnn

SEQ ID NO: 199691 - DNA, 437 bp, Homo sapiens
  misc_feature: GYAE6OF02IL1F9.47.24.C02.1.454.CMB.1.raw
  modified_base (430)..(437): a, c, t, g, unknown or other
  misc_feature (430)..(437): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagctctgagcgggctggcaaggcgcatagnnnnnnnn

SEQ ID NO: 199692 - DNA, 433 bp, Homo sapiens
  misc_feature: GYAE6OF02IELVG.47.24.C02.1.454.CMB.1.raw
  modified_base (428)..(433): a, c, t, g, unknown or other
  misc_feature (428)..(433): n is a, c, g, or t
tcagagctcacgtacacgaccggtgctcgatttagtacagatcgttgggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctgggggcaaagggaccgcggtcaccgtctcctcagcctccaccaagggcccatcggtcttcccctggcgccctgctccaggacgcacctccgagagcacagcggccctgggctgctggtcaaggactactcctacgtgagctctgagcgggctggcaaggcgcatagnnnnnn

SEQ ID NO: 199693 - DNA, 436 bp, Homo sapiens
  misc_feature: GYAE6OF02HE69D.47.24.C02.1.454.CMB.1.raw
  modified_base (430)..(436): a, c, t, g, unknown or other
  misc_feature (430)..(436): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttccccctggcgccctgctccaggagcacctccgagagcacagcggccctgggctgcctggtcaaggactacttcctacgtgagctctgagcgggctggcaaggcgcatagnnnnnnn

SEQ ID NO: 199694 - DNA, 442 bp, Homo sapiens
  misc_feature: GYAE6OF02JBLHC.47.24.C02.1.454.CMB.1.raw
  modified_base (432)..(432): a, c, t, g, unknown or other
  misc_feature (432)..(432): n is a, c, g, or t
  modified_base (437)..(442): a, c, t, g, unknown or other
  misc_feature (437)..(442): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatccggtcttccccctggccgcccctgcctccaggacgcacctccgagacgcacagcggccctgggctgcctggtcaaggctacttcctacgtgagctctgagcgggctgggcaagggcgnatagnnnnnn

SEQ ID NO: 199695 - DNA, 443 bp, Homo sapiens
  misc_feature: GYAE6OF02JCWIG.47.24.C02.1.454.CMB.1.raw
  modified_base (433)..(443): a, c, t, g, unknown or other
  misc_feature (433)..(443): n is a, c, g, or t
tcagagctcacgtacacgaccggtgctcgatttagtacagatcgttaggggaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttatactaccactcctacttggacgtctgggggcaaagggaccgcggtcaccgtctcctcagcctccaccaagggcccatcggtccttccccctggccgccctgctccaggagccacctccgagagcacagcggccctgggctgcctggtcaaggctacttcctacgtgagctctgagcgggctggcaagggcgcatagnnnnnnnnnnn

SEQ ID NO: 199696 - DNA, 433 bp, Homo sapiens
  misc_feature: GYAE6OF02IZ7VD.47.24.C02.1.454.CMB.1.raw
  modified_base (340)..(340): a, c, t, g, unknown or other
  misc_feature (340)..(340): n is a, c, g, or t
  modified_base (424)..(433): a, c, t, g, unknown or other
  misc_feature (424)..(433): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttatactaccactcctacttggacgtctggggcaaagggaccgcggtcaccgtctcctcagcctcaccaagggcccatcggtcttcccctggcgccctgctccaggngcacctccgagagcacagcgccctggctgcctggtcaaggactactcctacgtgagctctgagcgggctggcaaggcgcatagnnnnnnnnnn

SEQ ID NO: 199697 - DNA, 431 bp, Homo sapiens
  misc_feature: GYAE6OF02IY46M.47.24.C02.1.454.CMB.1.raw
  modified_base (428)..(431): a, c, t, g, unknown or other
  misc_feature (428)..(431): n is a, c, g, or t
tcagagctcacgtacacgaccggtgctcgatttagtacagatcgttagggaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttcccctggcgccctgctccaggacgcacctccgagagcacagcggccctgggctgctggtcaaggactacttcctacgtgagctctgagcgggctggcaaggcgcatagnnnn

SEQ ID NO: 199698 - DNA, 457 bp, Homo sapiens
  misc_feature: GYAE6OF02HH9YQ.47.24.C02.1.454.CMB.1.raw
  modified_base (443)..(457): a, c, t, g, unknown or other
  misc_feature (443)..(457): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttatactaccactcctacttggacgtctggggcaaagggaccgcggtcaccgtctcctcagcctccaccaagggcccatcggtccttccccctggccgccctgcctcccagggacgcaccctccggagacgcaccagccggccctgggctgcctggtcaaggactacttcctacgtgacgcctgagcgggctgggcaaggcgacatacgnnnnnnnnnnnnnnn

SEQ ID NO: 199699 - DNA, 442 bp, Homo sapiens
  misc_feature: GYAE6OF02G99PW.47.24.C02.1.454.CMB.1.raw
  modified_base (432)..(442): a, c, t, g, unknown or other
  misc_feature (432)..(442): n is a, c, g, or t
tcagagctcacgtacacgaccggtgctcgatttagtacagatcgttaggggaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttcccccctggccaccctcctccaacgacgcacctctgggggcacagcggccctgggctgcctggtcaaggactacttcctatgtatactctgagcggctggcaggcgcatagnnnnnnnnnnn

SEQ ID NO: 199700 - DNA, 548 bp, Homo sapiens
  misc_feature: GYAE6OF02JZ7MT.47.24.C02.1.454.CMB.1.raw
  modified_base (241)..(241): a, c, t, g, unknown or other
  misc_feature (241)..(241): n is a, c, g, or t
  modified_base (510)..(510): a, c, t, g, unknown or other
  misc_feature (510)..(510): n is a, c, g, or t
  modified_base (518)..(548): a, c, t, g, unknown or other
  misc_feature (518)..(548): n is a, c, g, or t
tcagagctcacgtacacgaccggtgctcgatttagtacagatcgttagggaaagggacgtggagtggattggctatgttcattccagtgggagcaccgactataacctctccctcaagggtcgagtcaccatcttggcagacacgtccaagcacccaaatttctccctgaagctgacttctatgaccgctgcggacgcgggccgtctattacttgtgcgaggaggggcacctcggtcccgntttattactaccacgtcctacttggaccttcgtgggggccaaaggggaccgcgggtcaccggtctccgtctaggcccctccacccgaacgggttcccactccgggttccttcccccccgtgggccctccccgtcgccgtcccagggacctcacctccgagacgccacgacgtcccgggccctggggcctacggcccgtggtcgaagggaacccttccgtttcccgtaacggtgtacgcgtctacgacgtcggggctggacgtacggcgntagaggcnnnnnnnnnnnnnnnnnnnnnnnnnnnnnnn

SEQ ID NO: 199701 - DNA, 477 bp, Homo sapiens
  misc_feature: GYAE6OF02IPVX6.47.24.C02.1.454.CMB.1.raw
  modified_base (420)..(420): a, c, t, g, unknown or other
  misc_feature (420)..(420): n is a, c, g, or t
  modified_base (450)..(477): a, c, t, g, unknown or other
  misc_feature (450)..(477): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgaggaggggcacctcggtccgcttattactaccactcctacttggacgtctggggacaaagggaccgcggtcaccgtctcctcacgcctccaccaagggccccagtccggtccttccccctggccgccctgcctccaggacgccacctccgagacgcaacagccgcctgggcctgcctggtcaacggtactacttcctacgtgagctntgacgcgggctggacacgggcgacagtagnnnnnnnnnnnnnnnnnnnnnnnnnnnn

SEQ ID NO: 199702 - DNA, 591 bp, Homo sapiens
  misc_feature: GYAE6OF02GRWWW.47.24.C02.1.454.CMB.1.raw
  modified_base (376)..(376): a, c, t, g, unknown or other
  misc_feature (376)..(376): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
  modified_base (566)..(567): a, c, t, g, unknown or other
  misc_feature (566)..(567): n is a, c, g, or t
  modified_base (569)..(575): a, c, t, g, unknown or other
  misc_feature (569)..(575): n is a, c, g, or t
  modified_base (577)..(582): a, c, t, g, unknown or other
  misc_feature (577)..(582): n is a, c, g, or t
  modified_base (584)..(584): a, c, t, g, unknown or other
  misc_feature (584)..(584): n is a, c, g, or t
  modified_base (586)..(591): a, c, t, g, unknown or other
  misc_feature (586)..(591): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggtcgtctattattgtgcgagaggggcaccgtcggtccgcttattacctaccactcctacttggacgtcgtggggcaaagggaccgcggtcaccgtctcctcacgcctccaccaacgggcccagtccggtccttcccccgtggcccgtccctcgcctccgaggacgccaccgtccgacggcnccgaacacggccggccccgtggggccgttcggcccgttcgggtaccgaaacgggtaccttaaccgtttcccttacgttacgtttaaccgtaccttccggttacggtaacggtcccggggtaccgttacggggacgtaaaccggggccggtacgaacgttacggacgtgacgtgcgngagncacngnngcnncnnnnnnngnnnnnncncnnnnnn

SEQ ID NO: 199703 - DNA, 637 bp, Homo sapiens
  misc_feature: GYAE6OF02IYSFK.47.24.C02.1.454.CMB.1.raw
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
  modified_base (579)..(579): a, c, t, g, unknown or other
  misc_feature (579)..(579): n is a, c, g, or t
  modified_base (604)..(604): a, c, t, g, unknown or other
  misc_feature (604)..(604): n is a, c, g, or t
  modified_base (633)..(633): a, c, t, g, unknown or other
  misc_feature (633)..(633): n is a, c, g, or t
tcagagctcacgtacacgaccggtgctcgatttagtacagatcgtttagggtaaaggggactgggagtggattcggctatggttcattccagtgggagcaccgactagtaaccctctccctcaagggttccgaggtcacccatccttggcagacaccgtccgtaaagcaccaattcctccctgaacgctgacttcctatcgaccgtcttgcggacgcggccgttctattattgtgcgagacgggtcaccttcggtccgcgttacgttactacctactccgtacttggaccgtctagggggtcaaagggaccggcggtccaaccggtctaccgtcgacgccgtccgaccgaaccgggtccctatccggtcctttcccccgtggccggccctcgccttccacggtacgccaccgttccggaggtaccgctacgacggccggacccgtggggcctggccgttggtaccgaaacggggacttaaccgtttccgttaccgtggtactccgtacctaggacgcggggcctggccaacggcgacagtaggtctcncncgatcatgacngtatcgngtcttcgtccncgtcgtcgtagcgagagtacggtanacgtcagaacgtcgtcgtcgtcgtcgacntacg

SEQ ID NO: 199704 - DNA, 467 bp, Homo sapiens
  misc_feature: GYAE6OF02IUKIF.47.24.C02.1.454.CMB.1.raw
  modified_base (343)..(343): a, c, t, g, unknown or other
  misc_feature (343)..(343): n is a, c, g, or t
  modified_base (411)..(411): a, c, t, g, unknown or other
  misc_feature (411)..(411): n is a, c, g, or t
  modified_base (430)..(431): a, c, t, g, unknown or other
  misc_feature (430)..(431): n is a, c, g, or t
  modified_base (434)..(467): a, c, t, g, unknown or other
  misc_feature (434)..(467): n is a, c, g, or t
tcagagctcacgtacacgaccggtgctcgatttagtacagatcgttgggaaagggactggagtggattggctatgttcattccagtgggagcaccgactataacctctccctcaagggtcgagtcaccatcttggcagacacgtccaaagcaccaattctccctgaagctgacttctatgaccgctgcggacgcggccgtctattattgtgcgagaggggcacctcggtccgcttatactaccactcctacttggacgtctgggggcaaagggaccgcggtcaccgtctcctcagcctccaccaagggcccatcggtccttcccctggcgccctgctcaggancacctcgagagcacagcgcctgggctgcctggtcaaggactacttcctatgtatactctgagcgggcnggacaaggccacgatacgnngannnnnnnnnnnnnnnnnnnnnnnnnnnnnnnnnn

SEQ ID NO: 199705 - DNA, 457 bp, Homo sapiens
  misc_feature: GYAE6OF02GR8MI.47.24.C02.1.454.CMB.1.raw
  modified_base (443)..(443): a, c, t, g, unknown or other
  misc_feature (443)..(443): n is a, c, g, or t
  modified_base (446)..(457): a, c, t, g, unknown or other
  misc_feature (446)..(457): n is a, c, g, or t
tcagagctcacgtacacgaccggtgctcgatttagtacagatcgttgggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcaccgtcggtccgcttattacctaccactcctacttggacgtcgtggggcaaagggccgcggtcaccgtctcctcagcctccaccaaggcccatcggtcttccccctggccgccctgctcccaggacgccacctccgagagcacagccggccctgggctgccgtggtcaaggcttacttcctacgtgacgctcgtggacgcggggtctgggcaagggcgacganagnnnnnnnnnnnn

SEQ ID NO: 199706 - DNA, 462 bp, Homo sapiens
  misc_feature: GYAE6OF02GQL9V.47.24.C02.1.454.CMB.1.raw
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (437)..(438): a, c, t, g, unknown or other
  misc_feature (437)..(438): n is a, c, g, or t
  modified_base (440)..(462): a, c, t, g, unknown or other
  misc_feature (440)..(462): n is a, c, g, or t
tcagagctcacgtacacgaccggtgctcgatttagtacagatcgttaggggaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattaataccactcctacttggacgtctggggcaaagggaccgcggtcaccgtctcctcagcctcaccaagggcccatcggtcttccccctggcgccctgctccaggacgcacctccgagagcacgacgcggccctgggctgcctggcaaggactacttcctacgtgagctcngagcgggngtcggacacgggcgcagtaggnngnnnnnnnnnnnnnnnnnnnnnnn

SEQ ID NO: 199707 - DNA, 515 bp, Homo sapiens
  misc_feature: GYAE6OF02HTFPN.47.24.C02.1.454.CMB.1.raw
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (493)..(515): a, c, t, g, unknown or other
  misc_feature (493)..(515): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcaccgtcggtccgcttattactaccactcctacttggacgtcgtggggcaaagggccgcggtccaccgtctcctcgacgccctccaccgaaacgggcccctactccgggttccttcccccgtcgggcccgccctgcctccgagggacgccacccgtccgacgacgacaccgaggccggcccgtgggcctcggcgttcgggtcaacgggtaccttaccgttcctacggtcgacgtctcgtggcggtcgggcgtgggcacgggcgactagngntnnnnnnnnnnnnnnnnnnnnnnn

SEQ ID NO: 199708 - DNA, 530 bp, Homo sapiens
  misc_feature: GYAE6OF02I2ZG8.47.24.C02.1.454.CMB.1.raw
  modified_base (491)..(491): a, c, t, g, unknown or other
  misc_feature (491)..(491): n is a, c, g, or t
  modified_base (497)..(530): a, c, t, g, unknown or other
  misc_feature (497)..(530): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcaccgtcggtccgcttattactaccactcctacttggacgtctggggcaaagggccgcggtcaccgtctcctcagcctccaccaagggcccagtccggtccttcccccgtggccgcccctgcctccgaggcgccacctccggagacgaccacacggccggcccgtgggcctcgccgtacggtacgaaacgtaccgttacctttccgtaccggtgacgtccttcgtcggacggccggggtcgtcgggaccgaaagggcccgacgtatacggntgactnnnnnnnnnnnnnnnnnnnnnnnnnnnnnnnnnn

SEQ ID NO: 199709 - DNA, 607 bp, Homo sapiens
  misc_feature: GYAE6OF02JXI05.47.24.C02.1.454.CMB.1.raw
  modified_base (168)..(168): a, c, t, g, unknown or other
  misc_feature (168)..(168): n is a, c, g, or t
  modified_base (179)..(179): a, c, t, g, unknown or other
  misc_feature (179)..(179): n is a, c, g, or t
  modified_base (421)..(421): a, c, t, g, unknown or other
  misc_feature (421)..(421): n is a, c, g, or t
  modified_base (522)..(522): a, c, t, g, unknown or other
  misc_feature (522)..(522): n is a, c, g, or t
  modified_base (543)..(543): a, c, t, g, unknown or other
  misc_feature (543)..(543): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (567)..(567): a, c, t, g, unknown or other
  misc_feature (567)..(567): n is a, c, g, or t
  modified_base (601)..(602): a, c, t, g, unknown or other
  misc_feature (601)..(602): n is a, c, g, or t
  modified_base (604)..(604): a, c, t, g, unknown or other
  misc_feature (604)..(604): n is a, c, g, or t
tcagagctcacgtacacgaccggtgctcgatttagtacagatcgttgggaaagggactggagtggattggctatgttcattccagtgggagcaccgactataacctctccctcaaggtcgagtcaccatcttggcagacacgtccaagcaccaattcctccctgaacnctgacttctancgaccgctgcggacgcggccgtctattatgtgcgaggagggcaccgtcgtcgcttagtacctacacttcctacgttggacgtcgtcggggcaaacgggaccacgggtcaccgttctcctcacgccctccacccgaacggccctacgtaccgggttccttacccccgcggaccctacccgtccctccgaaacgtacgccaaccgtccgtcggggccacgaccggccggtacccgtcgggtacnccggtcttcgggacgaacggtactttaccgtttacccgtacggtacgacgtaccgtcgtagacggtcgggacgtcggaccgtagggacctcgtagtcgacncgtcgagcgcgtgcgcgtacncgcgacgcgtgcncncgcgtgtcncgtcgcgtcgcgtatcgtgcgtgacgtcgtcgtnngngta

SEQ ID NO: 199710 - DNA, 436 bp, Homo sapiens
  misc_feature: GYAE6OF02ITGKQ.47.24.C02.1.454.CMB.1.raw
  modified_base (324)..(324): a, c, t, g, unknown or other
  misc_feature (324)..(324): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (415)..(436): a, c, t, g, unknown or other
  misc_feature (415)..(436): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaagggaccgcggtcaccgtctcctcagcctccacaggccatcggtcttcccctggcncctgcctcagngcacctccgagngcacagcgcctggctgcctgcaggctacttccacgtgagtctcgtgagcgggctggcaggcgcagtgnnnnnnnnnnnnnnnnnnnnnn

SEQ ID NO: 199711 - DNA, 600 bp, Homo sapiens
  misc_feature: GYAE6OF02GBFWM.47.24.C02.1.454.CMB.1.raw
  modified_base (535)..(535): a, c, t, g, unknown or other
  misc_feature (535)..(535): n is a, c, g, or t
  modified_base (543)..(543): a, c, t, g, unknown or other
  misc_feature (543)..(543): n is a, c, g, or t
  modified_base (549)..(549): a, c, t, g, unknown or other
  misc_feature (549)..(549): n is a, c, g, or t
  modified_base (557)..(557): a, c, t, g, unknown or other
  misc_feature (557)..(557): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (573)..(573): a, c, t, g, unknown or other
  misc_feature (573)..(573): n is a, c, g, or t
  modified_base (581)..(581): a, c, t, g, unknown or other
  misc_feature (581)..(581): n is a, c, g, or t
  modified_base (589)..(589): a, c, t, g, unknown or other
  misc_feature (589)..(589): n is a, c, g, or t
  modified_base (598)..(599): a, c, t, g, unknown or other
  misc_feature (598)..(599): n is a, c, g, or t
tcagagctcacgtacacgaccggtgctcgatttagtacagatcgttgggaaagggactggagtggattggctatgttcattccagtgggagcaccgactataacctctccctcaagggtcgagtcaccatcttggcagacacggtccaaagcaccaattctccctgaagctgacttctatgaccgctgcggacgcggccgtctattattgtgcgagagggcacctcggccgcttattactaccactcctaacttgggacgtcgtggggcaaagggaccgcggtcaccgttctcctcacggcctaccgaccgaacggccccaatccggttcctttccccccgtaggtcccgccccttgccgtaacgagggtacgccacccgttcccggagtacgccaacgacggccggccccgtgggcctggccgttagggtaccaaacgggtccttaaccgtttcccgtaacggtgacgtcttccgacggaacgggcccggggccttcgggacgaaaccggggcgtaccgagttacgggactgcncgatcgancgtaancgagacgngngnncngcncgtgcngctcgacncgcgagcncgcgcgcannc

SEQ ID NO: 199712 - DNA, 430 bp, Homo sapiens
  misc_feature: GYAE6OF02JDPWJ.47.24.C02.1.454.CMB.1.raw
  modified_base (420)..(420): a, c, t, g, unknown or other
  misc_feature (420)..(420): n is a, c, g, or t
  modified_base (424)..(430): a, c, t, g, unknown or other
  misc_feature (424)..(430): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctattggacgtcgtggggcaaagggaccgcggtcaccgtctcctcagcctcaccaaggcccatcggtctcccctggccgccctgctccaggacgcacctccgagacgcacagccggcctgggctgcctggtcaaggctactcctacgtgagctctgagcgggctggcaggcnatgnnnnnnn

SEQ ID NO: 199713 - DNA, 532 bp, Homo sapiens
  misc_feature: GYAE6OF02GTU6V.47.24.C02.1.454.CMB.1.raw
  modified_base (376)..(376): a, c, t, g, unknown or other
  misc_feature (376)..(376): n is a, c, g, or t
  modified_base (492)..(492): a, c, t, g, unknown or other
  misc_feature (492)..(492): n is a, c, g, or t
  modified_base (500)..(532): a, c, t, g, unknown or other
  misc_feature (500)..(532): n is a, c, g, or t
tcagagctcacgtacacgaccggtgctcgatttagtacagatcgttagggaagggactggagtggattggctatgttcattccagtgggagcaccgactataacctctccctcaagggtcagtcaccatcttggcagacacgtccaagcaccaattctccctgaagctgacttctatgaccgctgcggacgcggccgtctattattgtgcgaggagggcaccgtcggtccgcttattactaccactccttacttggacgtcgtggggacaaacggggaccgcggtccaccgtctcctcacgccctccgaacccgaacgggccccagtcccggttcccttcccccgtcgggcccgtcccctcgtccctccgaggacnccgacccgtccgaagcgccacgacggccggcccgtggctcggccgtggtacaacggtactaccttccgtacgtgacgtctcgtaggcggccgggcggtacggacgaacgggctacngtaacgcnnnnnnnnnnnnnnnnnnnnnnnnnnnnnnnnn

SEQ ID NO: 199714 - DNA, 492 bp, Homo sapiens
  misc_feature: GYAE6OF02HMOX1.47.24.C02.1.454.CMB.1.raw
  modified_base (187)..(187): a, c, t, g, unknown or other
  misc_feature (187)..(187): n is a, c, g, or t
  modified_base (381)..(381): a, c, t, g, unknown or other
  misc_feature (381)..(381): n is a, c, g, or t
  modified_base (397)..(397): a, c, t, g, unknown or other
  misc_feature (397)..(397): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
  modified_base (469)..(492): a, c, t, g, unknown or other
  misc_feature (469)..(492): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaaagcaccaattcctccctgaagctgacttctatgaccgntgcggacgcggccgtctattattgtgcgaggaggggcaccgtcggtccgcttattactaccactcctacttggacgtctgggggacaaaagggccgcggtccaccgtctcctcagcctcccaccgaagggccccatccggtcccttccccccgtggcccgccctggcctaccgaggacgccaccgtccgagacncgacgacgccggcccnggctcgcctggtcaaggcttactccgtacgngacgtctcgtcgngccgggctggacgaacggcgacagtagnnnnnnnnnnnnnnnnnnnnnnnn

SEQ ID NO: 199715 - DNA, 623 bp, Homo sapiens
  misc_feature: GYAE6OF02F40K6.47.24.C02.1.454.CMB.1.raw
  modified_base (216)..(216): a, c, t, g, unknown or other
  misc_feature (216)..(216): n is a, c, g, or t
  modified_base (303)..(303): a, c, t, g, unknown or other
  misc_feature (303)..(303): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (564)..(565): a, c, t, g, unknown or other
  misc_feature (564)..(565): n is a, c, g, or t
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
  modified_base (588)..(589): a, c, t, g, unknown or other
  misc_feature (588)..(589): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (603)..(604): a, c, t, g, unknown or other
  misc_feature (603)..(604): n is a, c, g, or t
  modified_base (606)..(607): a, c, t, g, unknown or other
  misc_feature (606)..(607): n is a, c, g, or t
  modified_base (610)..(610): a, c, t, g, unknown or other
  misc_feature (610)..(610): n is a, c, g, or t
  modified_base (621)..(621): a, c, t, g, unknown or other
  misc_feature (621)..(621): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattcctccctgaagctgactttctatgaccgctgcggacgcggccgtcttattattgtcgngaggaggggcaccgtcggtccgcttaattacctaccacttcctacttcggacgtcgtgggcgaaagggccgcgtcaccgtctcctcncgcctcccacgacgggccccagtccggtcccttccccgcggccgtccctgcctccgacggacgccctaccgtaccggacgacgaccgacggacgcccgggtcccgtacggggcttacggcccgttacgggtaccgaaacgggtacccctttaaccggtttccttaccgggttacggttaccggtttcgtacggacgggtcccgggtacgttcggggaccgtaaaggggcccgtaacgtaagttaggtcgacngcgtntcgnngacgcgtgcgtacngctgtgnanncgtacacgngcncnncnngtncgtgtctgtcntc

SEQ ID NO: 199716 - DNA, 581 bp, Homo sapiens
  misc_feature: GYAE6OF02IWN46.47.24.C02.1.454.CMB.1.raw
  modified_base (185)..(185): a, c, t, g, unknown or other
  misc_feature (185)..(185): n is a, c, g, or t
  modified_base (539)..(539): a, c, t, g, unknown or other
  misc_feature (539)..(539): n is a, c, g, or t
  modified_base (541)..(542): a, c, t, g, unknown or other
  misc_feature (541)..(542): n is a, c, g, or t
  modified_base (550)..(550): a, c, t, g, unknown or other
  misc_feature (550)..(550): n is a, c, g, or t
  modified_base (552)..(581): a, c, t, g, unknown or other
  misc_feature (552)..(581): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtccaagcaccaattctccctgaagctgacttctatgaccgntgcggacgcggctctattagttgtgcgaggaggggccaccgtcggtccgtctttaattacctacccacttccttacttcgggactcgtgggggacaaacgggccggcggtccaccgtcctcctaccacgtcccctacccaaccgaaccgggccctacgttcccggtcccctttcccccggtcgggcccgcccctggcctaacggacgggacgcccgacccgtacgacgacgccgaacgtaccggccgggaccccgtggggccttcggccgtaggtaccgaacgtacccttacgtccgtagtcgagtacctgtcggaggtcgggacgtcggaacgacgggcgacgtacggtacgngnngacgtcangnnnnnnnnnnnnnnnnnnnnnnnnnnnnnn

SEQ ID NO: 199717 - DNA, 822 bp, Homo sapiens
  misc_feature: GYAE6OF02GJ3TX.47.24.C02.1.454.CMB.1.raw
  modified_base (758)..(758): a, c, t, g, unknown or other
  misc_feature (758)..(758): n is a, c, g, or t
  modified_base (783)..(783): a, c, t, g, unknown or other
  misc_feature (783)..(783): n is a, c, g, or t
  modified_base (793)..(793): a, c, t, g, unknown or other
  misc_feature (793)..(793): n is a, c, g, or t
  modified_base (795)..(795): a, c, t, g, unknown or other
  misc_feature (795)..(795): n is a, c, g, or t
  modified_base (801)..(801): a, c, t, g, unknown or other
  misc_feature (801)..(801): n is a, c, g, or t
  modified_base (815)..(815): a, c, t, g, unknown or other
  misc_feature (815)..(815): n is a, c, g, or t
  modified_base (819)..(819): a, c, t, g, unknown or other
  misc_feature (819)..(819): n is a, c, g, or t
  modified_base (821)..(821): a, c, t, g, unknown or other
  misc_feature (821)..(821): n is a, c, g, or t
tcagagctcacgtacacgaccggtgctcgatttagtacagatcgtttagggaaagggactggagtggattggctatgttcattccagtgggagcacgactataacctctccctcaagggtcagtcacactcttggcagacacgtaccaagccaacctaatttccgtcccgtagaacgcgtacgtactttctagtcgaccgtctacggaccggacgtccggtaccgttacttaagtttagttcggtaggaccggaaggggacggggaccctaccggttaccgggtcccgtacttttaacttaacctaaccctaccttaccttacggttacgggaccgttcgggtacgggggaaccgtaaacgggggacccggtacggttacccgtaacccggttccttacccgttaccgaccggtcccctaacccgaaacccggtaaccggggtacccctaacggttcccgggttcccctttacccccggtcggtacccctaccccctttaccccgtaaccgtaaacggaccggaccctacccggttccgggtacggggggacccacggaccggcccggtacccggtcgggtccgtcggtaccgttacgggtaacctaacgggtaaccctttacccgtttaccggttaaccgggtacggtaccgtccgttacggtacgggtaccgggtccggggtacggttacgggaaccgggtaaacgggtccggtaacgtaacgttaggacgtagacgagtacgacgacgtacgacncacacgcgtacactcgtacgacgcncgtacacacncncgcacncgagagagctcacncgcngnc

SEQ ID NO: 199718 - DNA, 780 bp, Homo sapiens
  misc_feature: GYAE6OF02IPB6E.47.24.C02.1.454.CMB.1.raw
  modified_base (314)..(314): a, c, t, g, unknown or other
  misc_feature (314)..(314): n is a, c, g, or t
  modified_base (709)..(709): a, c, t, g, unknown or other
  misc_feature (709)..(709): n is a, c, g, or t
  modified_base (711)..(711): a, c, t, g, unknown or other
  misc_feature (711)..(711): n is a, c, g, or t
  modified_base (713)..(713): a, c, t, g, unknown or other
  misc_feature (713)..(713): n is a, c, g, or t
  modified_base (717)..(717): a, c, t, g, unknown or other
  misc_feature (717)..(717): n is a, c, g, or t
  modified_base (720)..(720): a, c, t, g, unknown or other
  misc_feature (720)..(720): n is a, c, g, or t
  modified_base (722)..(722): a, c, t, g, unknown or other
  misc_feature (722)..(722): n is a, c, g, or t
  modified_base (725)..(725): a, c, t, g, unknown or other
  misc_feature (725)..(725): n is a, c, g, or t
  modified_base (728)..(728): a, c, t, g, unknown or other
  misc_feature (728)..(728): n is a, c, g, or t
  modified_base (733)..(733): a, c, t, g, unknown or other
  misc_feature (733)..(733): n is a, c, g, or t
  modified_base (747)..(748): a, c, t, g, unknown or other
  misc_feature (747)..(748): n is a, c, g, or t
  modified_base (760)..(760): a, c, t, g, unknown or other
  misc_feature (760)..(760): n is a, c, g, or t
  modified_base (767)..(767): a, c, t, g, unknown or other
  misc_feature (767)..(767): n is a, c, g, or t
  modified_base (773)..(773): a, c, t, g, unknown or other
  misc_feature (773)..(773): n is a, c, g, or t
  modified_base (776)..(776): a, c, t, g, unknown or other
  misc_feature (776)..(776): n is a, c, g, or t
tcagagctcacgtacacgaccggtgctcgatttagtacagatcgttaagggaaagggactggagtggattggctatgttcattccaggtgggagcaccgactataacctctccctcgaagggtcgagtcaccatcttggcagacacgtccaagcaccaattctccctgaagctgactttctatgaccgctcggcggacggcggttctcgttatttacgtgttggacgaggtacgggcaccgtcggtccgtacttattaccacctacgttcctacttcgggacgtccggtcgggggacgtaaacggggccccggnggtccgtacccggttccttccgtccacggtccccctcccggtaacccaaccgggggccccgtaaccggtttcccgggttccccgtttcccccgtcggggacccgtcccccgtaccggtcccttaacccgggacgggtaaccggtcccctaaccggcgggtaaacgcgacccgaaccggtaccgggtacccgggggtcccccgttgggggtacccctaggggttccccgttacgggttaacccgggaaaaccgggttccctttaaacccgttttccccggggaacggttttcggggaacctttaccggttacccgggtcggggaacccgggggttcccggggtacggtaccggggtacccgtaaacgggtccccgggaacctaggttaggcctcgngngngtcncgngntcncgngcgtncgctgtgtactgtnncgtcgtcactgnacgtgcncgtctntancgtg

SEQ ID NO: 199719 - DNA, 554 bp, Homo sapiens
  misc_feature: GYAE6OF02HHT4K.47.24.C02.1.454.CMB.1.raw
  modified_base (246)..(246): a, c, t, g, unknown or other
  misc_feature (246)..(246): n is a, c, g, or t
  modified_base (325)..(325): a, c, t, g, unknown or other
  misc_feature (325)..(325): n is a, c, g, or t
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(528): a, c, t, g, unknown or other
  misc_feature (526)..(528): n is a, c, g, or t
  modified_base (530)..(530): a, c, t, g, unknown or other
  misc_feature (530)..(530): n is a, c, g, or t
  modified_base (532)..(554): a, c, t, g, unknown or other
  misc_feature (532)..(554): n is a, c, g, or t
tcagagctcacgtacacgaccggtgctcgatttagtacagatcgttagggaaagggactggagtggattggctatgttcattcccagtgggagcaccgactataacctctccctcaagggtcagtcaccatcttggcagacacgtccaagcaccaattcctccctgaagctgacttctatcgaccgctgcggacgcggtcgtctattattggtgccgtaggagggggccacccgtcggtacccgtnttacttacctacccaccttccctacttgggaccgtcgtcgggggacaaaaggggtcccgcggtccacccggtctccctnacgccctccaacccgaacggggcccacgttccggtaccccttccccccgngggcccgtacccctggcctacccgaggacgccaccgtcccgagcgacaccgtagcccgccgtgggctcnccgtgggcaaggtccttacttccgtagtcgtctgtcggaggtccgggctcgggacacgggcgtaacngttacngtnangnannntnannnnnnnnnnnnnnnnnnnnnnn

SEQ ID NO: 199720 - DNA, 842 bp, Homo sapiens
  misc_feature: GYAE6OF02FHAVJ.47.24.C02.1.454.CMB.1.raw
  modified_base (799)..(799): a, c, t, g, unknown or other
  misc_feature (799)..(799): n is a, c, g, or t
tcagagctcacgtacacgaccggtgctcgatttagtacagatcgttagggaaagggactggagtcggattggctatgttcattccagtgggagcaccgactataacctctccctcaagggtcgagtcaccatcttggcagacacgtcccaagcacctaattctaccctgaacgctgaacctttctaatcggacccgtctcgcgggaccgcggtccgttcttaattactttggtagccggtaaggacggggcctaaccgtccggtccgtactttaacttacctaaccgtacttccgttaacgttacggtaaccgttccgtaggggggacctaaacggggaccggtcggtacctaccggttcctacccgtacacggtacccctacccgaaccgtaaccgggacccctaacgtttcccggttccctttccccccggtagggccctaccccgtgtcccgtacccgtaacgggtacgcccgtaacccgtacccggtaaggacgtaccaccgtaacggcccggggtcccctaggggtcccttaccggtaccgttcggggtaacctaacggggtaaccctttaaccgttttccccggttaaacgttcgaacccggttcgttacccggtacgggtaccggggttaccggggtaccgtttaccgggggaccgtaaaccggggttccgtaaccgggtacgtttaaccgcgttacgaacgttaccgcgtaaaccgcgttcccagtaggacctaaggtcttacccggaacttgtaacggcgttccaattcgaaagtcccttaagtacccgngaccgttccaagtcgtacgtacgtacgtacgtacgttcgtacg

SEQ ID NO: 199721 - DNA, 743 bp, Homo sapiens
  misc_feature: GYAE6OF02JJN77.47.24.C02.1.454.CMB.1.raw
  modified_base (657)..(657): a, c, t, g, unknown or other
  misc_feature (657)..(657): n is a, c, g, or t
  modified_base (679)..(679): a, c, t, g, unknown or other
  misc_feature (679)..(679): n is a, c, g, or t
  modified_base (681)..(681): a, c, t, g, unknown or other
  misc_feature (681)..(681): n is a, c, g, or t
  modified_base (686)..(686): a, c, t, g, unknown or other
  misc_feature (686)..(686): n is a, c, g, or t
  modified_base (701)..(701): a, c, t, g, unknown or other
  misc_feature (701)..(701): n is a, c, g, or t
  modified_base (720)..(720): a, c, t, g, unknown or other
  misc_feature (720)..(720): n is a, c, g, or t
  modified_base (741)..(741): a, c, t, g, unknown or other
  misc_feature (741)..(741): n is a, c, g, or t
tcagagctcacgtacacgaccggtgctcgatttagtacagatcgttagggaaagggactggagtggattggctatgttcattccagtgggagcaccgactataacctctccctcaagggtcgagtcaccatcttggcagacacgtcaagcaccaattctcctagaagctagacttctagtcgaccgctgcggaccggcggccgtctattattggtgcgaggacgggcaccgttcggtccgtcttacttacctacctactcccttagttcggaccgttcggacgggggcaaaaggggcccggtacggtccaaccggtccgttaccctctacgacccttcccaaccgtaaccgggtcccctaagttccggttacccctttcccccggtcggcccggtaccccgtcgtccggtacccgtaacggaccgtaccgaccccgttccgggaacgtaaccgacccgtacggaccggtcccggggtaaccccggtcgggtacccgtttccggaccggtttacgggtaacccgtaaaccggggttaaaccctttacccgttacccgggtttaaccgttacgggtaccgtttaccgttaccggtgggaaccgggtacgggtccggtaaacggggccgtaaacgggtccgtaaaccggactacggttancgtgtaggcctagtcacgacgnancgcgngtcgtcgctacgacncacgacagtcgagtacganatagacggacgtgtcgtcacntc

SEQ ID NO: 199722 - DNA, 503 bp, Homo sapiens
  misc_feature: GYAE6OF01AXUDO.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggttcagtggcagtgggtctggggcagacttcactctcaccatcagcagactggagcctgaagtattttgactagttgtattattgtcagcagcatcatcggtcaccgtacacgttttggcctagggaccaggctaggagagtacgaaacgactgtcgctcgcaccatctgtcttc

SEQ ID NO: 199723 - DNA, 520 bp, Homo sapiens
  misc_feature: GYAE6OF01AHFXS.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggttcagtggcagtgggtctggggcaggacttcgactctcaccatcagcagcgtggagcctgaagtatttgctagttgtattattgtcagcagcatcatcggtcaccgttactacgttttggccgacggggaccaaggcgttaggagagtacaaacggaactggtacggtctgaccacattctgttcttaccg

SEQ ID NO: 199724 - DNA, 549 bp, Homo sapiens
  misc_feature: GYAE6OF01DSJWX.34.22.B11.1.454.CMB.1.raw
  modified_base (196)..(196): a, c, t, g, unknown or other
  misc_feature (196)..(196): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccgtgtctgtgtctccaggggaaangtcaccctctcctgcagggccagccagagtgttagcagcaacttggcctggtaccagcagaaacctggccaggctcccaggctcctcatctatggtgcatccaccagggccacgtggtactcccagacaggttcaggtggcaggtgggtctgggacagacttcactctcaccatcagcagacttgagctagaagtatttgctagtatattactgtacagtactaatatcgagacgactacgtggtgggtcggttcggaccgaacgggaaccgtaagggtaggaaacgtacgaaaacggtaacgtaggtacggtcgtacgaccacctacttacttagttccttctacgttcccg

SEQ ID NO: 199725 - DNA, 535 bp, Homo sapiens
  misc_feature: GYAE6OF01CV18D.34.22.B11.1.454.CMB.1.raw
  modified_base (439)..(439): a, c, t, g, unknown or other
  misc_feature (439)..(439): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttctagcctggtatcagcagaaacctggcctggccgcccaggcctcctcatctataatgcctatagcagggccacgtcggccgtacccagacaggttcaggtggcgtaggtggggtcgtggggcaggacttcgactctccacatcagcagactggagcctagaagtattttgactagttagtattacgttgtcagtcagnatcagtcggtactaccgtactacgtttggaccgacgggaccaaggcgtaggagaacgtacgaaagactggtagcgtcgaccacaatctgtcttacg

SEQ ID NO: 199726 - DNA, 497 bp, Homo sapiens
  misc_feature: GYAE6OF01CPVSB.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggtcagtggcagtggtctggggcagacttcactctcaccatcagcagactggagcctagaagtattttgctagtgtattattgtcagcagcatcacgtcgtcaccgtactacgttttggaccgagggaccagcgtggagagtacaacgactgtgctgcacatctgtcttc

SEQ ID NO: 199727 - DNA, 510 bp, Homo sapiens
  misc_feature: GYAE6OF01E0MAU.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctccttcggggccagtcagagtattagtagctacttcttagcctggtatcagcagaaacctggcctggcgcccaggctcctcatctataatgcctatagcagggccacgtggccgtcccagacaggttcagtggcaggtggtcgtggggcagacttcactctcaccatcagcagactggacgtccgtgaagtatttgctagtgttattattgtctagcagcatcagtcggtcaccgtactacgtttcggccgagggaccaagcgtggagatacgaaacgactggtgctgctacatctctctctac

SEQ ID NO: 199728 - DNA, 577 bp, Homo sapiens
  misc_feature: GYAE6OF01DL9LM.34.22.B11.1.454.CMB.1.raw
  modified_base (328)..(328): a, c, t, g, unknown or other
  misc_feature (328)..(328): n is a, c, g, or t
tcagtacacgtgatcacgaccggtgctcgatttagacgacagctcagggggaggaactgctcagttaggacccagagggaaccatggaaaccccagcgcagcttctcttcctcctgatactctggctcccagataccaccggagaaattgtgttgacgcagtctccagccaccctgtctttgctccaggggacagagcccaccctctcctgccggggccagtcagagtattagagctacttcttagcctggtatcagcaagaacctggcctggccgcccaggcctcctcatctatatgacctatagcagggccatggcctcccagacngttcagtggctaggtcgggtcgtgggggcacgtacttcactctacaccatcagacagacgtggagcctagaagtatttgactagttgttatttagttagtcgagtacgagtactactctacgtccggtaccgtaccgttacgttacgttttcggaccgtacggggaccgtaacgtcgtacggagtaacgtaacgaaacggtaacgttcggtacggtacgtacgtaccaacctattcgtcgttcttaccg

SEQ ID NO: 199729 - DNA, 565 bp, Homo sapiens
  misc_feature: GYAE6OF01EVW9X.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcctagcctggtatcagcagaaacctggcctggcgcccaggctcctcatctataatgcctatagcagggccacgtggcgtcccagacaggttcagtggcagtgggtcgtggggcagacttcactctcacatcagcagactggacgccgtagaagtatttgacgtagttgtatttagttgtcgagcagtcatcacgtacggtactaccgttacgttacgttttcgggaccgtacggggaccaaggtcgtagggaacgtaacgtaccgaaacggtaacgttggtacggtaccgtacgtacctaacctaattcgttcgttcgttaccg

SEQ ID NO: 199730 - DNA, 563 bp, Homo sapiens
  misc_feature: GYAE6OF01CS2SD.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccgaggggacagagccaccctctcctggcggggccagtcagagtattagtagctacttcttagcctggtatcagcaagaaacctggcctggccgcccaggcctcctcatctataatcgcctaatacgcacgggcccacgtcggccgtacccaagacgaggttcaaggtggcgtaggtgggtcgtgggggcaggacttcactctcaccatcagctagacgtggacgcctagaagtagttttgactagttagttattagttgtcagcagtcatcagtccggtctaccgtactacgtttcggaccgacgggaccaagtcgtaggagaacgtacgaaacggacgtgtacggcgtacggaccaacctatcgttgtctttaccg

SEQ ID NO: 199731 - DNA, 808 bp, Homo sapiens
  misc_feature: GYAE6OF01A2PO7.34.22.B11.1.454.CMB.1.raw
  modified_base (278)..(278): a, c, t, g, unknown or other
  misc_feature (278)..(278): n is a, c, g, or t
tcagtacacgtgatcacgaccggtgctcgatttagacgacagctctagggggtaggggaactggctccagttaggacccaggagggtaccagtggtaaaccccagtcggcagcttctcttcctcctagctactcgtggctcccagagtaccttaccgggagaaattgtgtttggttaccgtctagtcttccgtaaaggccaccctgttctttggtcgtccgaggggacagaggccgacctctccgtggcggggccagtcacgagtacgttagggtacnctacttcttacgccttggtactcaggcctacgtaaaccgttggaccgttgggtccgcccgaaggccttccctactattcctagttaacgtcgacctagtacgccgaggggccgacgtgggaccgtcccgagtactaggttactaggttaggcgtaggttacgggtacgtacggggacctaacggaccgttcgaccgttccgtaccgaacgtacgtccgacgtacctaagtaccgttacggacgaccgtaagtaaacgttacgttttacggaaccctaagttacgtttaactttacgtttacgtaactacggtacctaacggtctaacgtacgaacggttacccgggtaacccgtaacccgggttaaccgtttaccggttttttaacgggacccggttaacggggggtaccctaacggggtaccggttaagggtaacgtaacgttaacggtaaacggttaacgttagggttacggttaccgttacggtacccgtaacgtacgggttacctttccgggttacccgttaccgg

SEQ ID NO: 199732 - DNA, 551 bp, Homo sapiens
  misc_feature: GYAE6OF01A5ILC.34.22.B11.1.454.CMB.1.raw
tcagtacacgtgatcacgaccggtgctcgatttagacgacagctcagggggaggaacctgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggttcagtggcagtgggtctggggcagacttcactctcaccatcagcagactggagcctagaagtattttgctagttgttattattgtcagcagcatcatcggtctaaccgttactaccgttttcggcccgtaacggggaccctaaggcgtagggaagtaacgtaccgaaacgtaacgtggtacggaccttacgcctaacctaattccttcgtcctttacccg

SEQ ID NO: 199733 - DNA, 583 bp, Homo sapiens
  misc_feature: GYAE6OF01BZ4LK.34.22.B11.1.454.CMB.1.raw
  modified_base (195)..(195): a, c, t, g, unknown or other
  misc_feature (195)..(195): n is a, c, g, or t
  modified_base (343)..(343): a, c, t, g, unknown or other
  misc_feature (343)..(343): n is a, c, g, or t
tcagtacacgtgatcacgaccggtgctcgatttagacgacagctcagggggaggaactgctcagttaggacccagacggaaccatggaagccccagcgcagcttctcttcctcctgctactctggctcccagacaccactggagaaatagtgatgacgcagtctccagccaccctgtctttgctccgaggggaangccaccctctcctgcagggccagtcagagtgtagcgctactgcctggaccagcagaactggccagctccagcctctcatctatgatcgcgtaccaacgcgggccactggcactcccagcccgtaggttcaggtggctaggtcgggtcngggccagtaccttcactctacaccatcgagcacgtacctagacgtactaaagttatttacgacttaatttacttactcgtactacgtctaggtcttaacgcgtaacgttcggtacccttccgttagaccggtccgtcccggttaccggacccgggtacgggaccgtacggtacgtacgggtaacgtaagttaaccggtacgtggtacggtacgtacgacctaccgtacttcgtcgttacc

SEQ ID NO: 199734 - DNA, 775 bp, Homo sapiens
  misc_feature: GYAE6OF01BJO2W.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccacctgtctttgtctccgaggggacagagccaccctctcctgcggggccagtcagagtattagtagtctacttctagcctgtatcgagcagaaacctgcctgcgccaggctcctcatctaataatcgtacctatagcgacgggccacgtggccgtacccgagaccgtaggttccaaggtcggccgtaggtcggggtcgtcgggggactacgtacgttacgaccgttccgtacctacccgaagttaccgaaacgtaccggtaacggtacccggttaggggtaccggtacccggttaacggtaaaacggttttaatttttacgggaccgtttaaaggtttaaggttttaactttttaaggtttccggtaacgtaacggtactaacgggttaccttaacgttaacccgtaacggtttaccccggttaacccgttaacccggtttaaccgtttaaccggtttttcgggaccccgggtaagggggtaacccccttaagggtaccggttagggtaaaccgtaacgtaaacccggtaaaaccggtaacggttcggttaccgggtacctacggtaccctaacgttaacgttcgtttaccgtccgtttaaccccg

SEQ ID NO: 199735 - DNA, 557 bp, Homo sapiens
  misc_feature: GYAE6OF01CB06I.34.22.B11.1.454.CMB.1.raw
  modified_base (290)..(290): a, c, t, g, unknown or other
  misc_feature (290)..(290): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccgaggggacagagccaccctctcctgcggggccagtcagagtattagtagctacttcttagcctggtatcagcagaaacctggcctggcgcccaggcctcctcntctataatcgcctatacgcacgggccacgtcggccgtcccaagacaggttcaggtgcaggtgggcgtggggcagacttcacttctcaccatcagcagactggagcctgaagtatttgctagtgtatttatgtcagcagcatcatccggtcaaccgttactacgtttcgggacccgacggggaacctaaggtcgtagggaacgtaacgtacgaaaaccggacttggtaccggacttcgaccaaccgtattcgttcgttcctttacccg

SEQ ID NO: 199736 - DNA, 561 bp, Homo sapiens
  misc_feature: GYAE6OF01ET553.34.22.B11.1.454.CMB.1.raw
  modified_base (294)..(294): a, c, t, g, unknown or other
  misc_feature (294)..(294): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtgttagcggctacttagcctggtaccagcagaaacctggccagcctcccagactcctcattaatggtncatactacagggcccctggcactcccagacaggttcagtggcaggtgggtctgggacagtacttcactctcacatcaccagacgtggacgtctagaacgtatttgctagtgttattactgtacacgtagttcgtctacacactacgtgacgttcggacgaacggaccgtaaggtacggaaatacgaaacgtagtgtagctagacctactattcgttcgttccgttactaacgttcccttaccccggtacctacgttccgtagtaacg

SEQ ID NO: 199737 - DNA, 521 bp, Homo sapiens
  misc_feature: GYAE6OF01B5Q1Q.34.22.B11.1.454.CMB.1.raw
  modified_base (274)..(274): a, c, t, g, unknown or other
  misc_feature (274)..(274): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctccttcggggccagtcagagtattagtagctacttcttagcctggtatcagcagaacctggcctggcncccaggctcctcatctataatgcctatagcagggccacgtggcgtcccagacaggttcagtggcaggtgggtctggggcaggacttcactctcacatcagcagactggagcctgaagtattttgctagtgttattattgtcagtcagctatcatcggtactaccgtactacgtttcggccgagggtacaagcgtaggagtagtacgaaacgtataggtcggacgtcgactacattctcgttctctac

SEQ ID NO: 199738 - DNA, 698 bp, Homo sapiens
  misc_feature: GYAE6OF01DD0XU.34.22.B11.1.454.CMB.1.raw
  modified_base (191)..(192): a, c, t, g, unknown or other
  misc_feature (191)..(192): n is a, c, g, or t
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (456)..(456): a, c, t, g, unknown or other
  misc_feature (456)..(456): n is a, c, g, or t
  modified_base (679)..(679): a, c, t, g, unknown or other
  misc_feature (679)..(679): n is a, c, g, or t
tcagtacacgtgatcacgaccggtgctcgatttagacgacagctcagggggaggaactgctcagttaggacccagagggaaccatggaaacccagcgcagcttctcttcctcctgctactctggctcccagataccacggagaattgtgttgacgcagtctccagcccacctgtctttgctcgagggaaannccaccctctcngcagggccagtcagtagttgttagcgtacttacgttagcctaggtaccagaccaagaaacctggccaggcctaccgaggcctccncatctatgactgcgtaccaacgcgggccacgtggcactcccgagtcctagggttccaggtggacgtaggttcgggtcgtcggggacctacgtactttcaccttctaccaccgtagtacccgaaggtacccaggtccctaaaggtaccggtaacccttaaaagggtttntttttaacggaacttttaaatttttaacgtttaaccgttgttaccgtaaggtccgttagggtacgttaaccgtaccgtaaccggttccggttaccccttccgttaggacccgtcccgggttcccgttaccggggacccggagggtacccgaacggaccggtaaggaacgttaacgttaaacggaacggttggtacggtcgtacgacctaccgtacttacgttnttaccttctccgttccccg

SEQ ID NO: 199739 - DNA, 563 bp, Homo sapiens
  misc_feature: GYAE6OF01AD6X2.34.22.B11.1.454.CMB.1.raw
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaacctggcctggcgcccaggctcctcatctataatgcctatagccagggcccacgtcggcgtcccagacaggttcaggtggctaggtgggtctgggggcaggtacttcactcncacatcagcagcgtgganccgtagaagtagtttgcgtagttgtattattgtactagctagctactactagtccggtactaacccgttactacgttttcggaccggtaacggggacctaaggcgtagggagaacgtaacgaaacggtacgtcggtcggtactcgacctacctagttcttcgtcctttaccg

SEQ ID NO: 199740 - DNA, 667 bp, Homo sapiens
  misc_feature: GYAE6OF01DO6KE.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagatactactggagaaaatagtgatgacgcagtctccagccaccctgtctgtcgtaccccgaaggggaaagacgccaacttccctcctcctgcgacggggccagtcaagtagttattagaccaacctaacttagccgtaggtaccagacaacgaaaccgtcggaccacgacctccgagcctaccctcactctagtggtcgacactcccgaaccgacgggcctaacgtcggtactcccgaggctacggttcaggtcggcgtagggtcggggtacgtaggggactaggtacgttccaactccgtaccaaccgtaactacgaacgcgtaacgttcgtcgtacgtacgttactaggtaagttattttcggactttaacgtttaattactgtactagactaacttaagtaaagtaacggtcggacccttacggtacttacccgacgttccggaccgaagggtaccaacgtacgtaggtaacgtaaacgttaaacgacgttagggtacgtctacggacaaccgtattcgttgttccttaaccg

SEQ ID NO: 199741 - DNA, 673 bp, Homo sapiens
  misc_feature: GYAE6OF01CVRF4.34.22.B11.1.454.CMB.1.raw
  modified_base (301)..(301): a, c, t, g, unknown or other
  misc_feature (301)..(301): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagacgccaccctctcctgccggggccagtcagagtgttaatagcatctacttagcctggtaccagcagaacctggaccagcctcccagacctcctctattaatggtncatactacgacgggcccctggctactcccaagtacaggttcaagtggctaggtgggtcgtgggacagtacttcgactctacaccataccaccgagactgggacgtacctaggaagtagttttgacgtagttacgtttaacgttacgttacgtacctaacgtacggtttcggttacttaccaactaccgtacggttacgggtaaccggtttaccggaacccggtaacgggaccgtaaagggttaacggtaaacgtaaaccgtaaaaccggtacgtacggtacggtaccgttacggacctaacccgtacgttaccgttacgtttacctttaccgtacctttaccccgtttacccccggccttacgtttacccgg

SEQ ID NO: 199742 - DNA, 504 bp, Homo sapiens
  misc_feature: GYAE6OF01D7R3A.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggttcagtggcagtgggtctggggcagacttcactctcaccatcagcagactggagcctgaagtattttgctagtgtattattgtcagcagcatcatcggtcaccgttactacttttggccgagggaccaagcgtggagatacgaaacgaactgtaggctgcaccatctgtcttacc

SEQ ID NO: 199743 - DNA, 557 bp, Homo sapiens
  misc_feature: GYAE6OF01C48X6.34.22.B11.1.454.CMB.1.raw
  modified_base (311)..(311): a, c, t, g, unknown or other
  misc_feature (311)..(311): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagacgcccaccctctcctgccggggccagtcagagtattagtagctacttcttagcctggtatcagcaagaaacctggcctggcgcccaggcctcctcatctatgctacatccaccnggcccactgctattccagccaggttcagtggctaggtgggtctgggacagtcgttcactctcacctatcagcagcctgcagtctgaagtnttcngtctaactttattactgtcagctagtactaaagtaggtcggtccgttggaccgttcgggaccgtaagggaaccgtaagggtaggaaacttacgaaaacgtacgttggtaggcctagcccgtaactagttcctagttccttcgtattcccccg

SEQ ID NO: 199744 - DNA, 509 bp, Homo sapiens
  misc_feature: GYAE6OF01BC81X.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttctagcctggtatcagcagaaacctggcctggcgcccaggctcctcatctataatgcctatgcagggccactggcgtccagacaggttcagtgcagtgggtctggggcagtcttcactctcacatcagcagactggacgccgtagaagtatttgcgtagttgtatttattgtctagcagctatcatcggtcaccgttactacgttttcggaccgacgggaccaaggcgtaggagtagtacaacgactggtgctcgcactatctgtcttc

SEQ ID NO: 199745 - DNA, 589 bp, Homo sapiens
  misc_feature: GYAE6OF01DDRT7.34.22.B11.1.454.CMB.1.raw
  modified_base (435)..(435): a, c, t, g, unknown or other
  misc_feature (435)..(435): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaattgtgttgacgcagtctccagcccaccctgttctttgtctccgaggggacagacgcccaccctctcctggccggggccagtcagagttattagtagcttacttcttagccttggtatcagacaagaaacctggcctggccgtcccgaggcctcctcatactataatcgacctagtacgcgagggccacgtcggcctacccagacgtggttcgagtcggcgtaggtggggtcgtggggccaggtacttcactcctcaccatcagcagacgtggacgtccgtagtaagttntttgacgtagttcgttatttagttcgtacacgtcagtactatcgtacgttccgtaccgtaccgttacgttacgtttcggaccgtagggacctagtcgaggtactaacgtacaaacgtacgtggacgctacgactacctattcgtgttcttaccg

SEQ ID NO: 199746 - DNA, 768 bp, Homo sapiens
  misc_feature: GYAE6OF01CSV18.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagtaattgtgttgacgcagtcctccacgccctaccctgttctttgtcctccgaggggacagacgcccaccctctccgtggccgggccagtcagtagtattagagcttactttgtacgccttggtactcagacgaacgaaccgtcggccgtcggccgcccgacggtcctcctactactacctaattaacgtcgtacctagtacggaccgacgggaccctacgtcgggccctaccgaacggacgtaggtcgaggtggcgtagggtcgggtacgtcgggggacctaacggtaccttaccgtaccttaccgtaccctaaacccgtaagtccgaacggacgaacggtaccggtacgggaccgtaccggttaagtaaacgtttagtttacggtacgttaaggttagtttaagtttacgttagtacgtacgacgtaacgtactactacgtacgtacccggttacccgtaacccggtttaccgttaccggttttaccgggaacccggtaacggggaaccgtaacgggtcggtaaaccgggaacgtaaaccggtaaccgtaaaccgggtaacggttcggtaccgggtacgttacgaacccgttactaccgtttacgttccgttaccgtttacccg

SEQ ID NO: 199747 - DNA, 590 bp, Homo sapiens
  misc_feature: GYAE6OF01EVWRP.34.22.B11.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccactggagaaattgtgttgacgcagtcgccagacaccctgtctctgtctccgaggggaaangccaccctctcctgcagggtcagtcagtcgttctaacnccgtacttcttcgcctggtaccagcagagacctggccaggctccaggctctcatcgtttggcgcgtccaccgagggccacgtggctacgtcccaggactaggttccagtcggctaggtgggtctggggactaggtacttcacttctacacctagtcagcaagtacttgacgtctagtaagtatttagactagtatattacgtgtcagtactaatactacgacgacgactacgtggtacgggtacgttacggaccgtaacgggtaaccgaagggtacggtaaagtaaccgaaacggtacgttacggtaggtacgtacgactaccgtacttacgtagttacctttctacgttacccg

SEQ ID NO: 199748 - DNA, 707 bp, Homo sapiens
  misc_feature: GYAE6OF01BDKCP.34.22.B11.1.454.CMB.1.raw
  modified_base (142)..(142): a, c, t, g, unknown or other
  misc_feature (142)..(142): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctccagataccacgganaattgtgttgacgcagtctccacgcccaccctgttctttgtcctccgaggggacagacgcccaccctctccgttcggggcctagtcagagttattagtagtcttacttcgttagcctggtatcgagacaacgaacctcggccgtggcccncccgagcctcctnactctaatacgtcgacctagacgcgacggccacgtcggccgtacccagacgtacggttcaggtcggacgtagggtcgggtacgtcggggactacggtacctttccgaccgttccttaccgaacccgtacgttacgacgtacggtaacggtaccggtacgggaacgtacccgttaagggtaacggtttaacgttttcggtacggttaggtttaacgtttagtttacgtttcgtacgtacgtacgtacgtactacgttacgtacgttccgtaccgttaccgttacgttaccggttttacggaccggtacgggaaccgtaacgtcggtacgtacgtaacgtaacgtaaaccggtagtacggtcgtacgtacgtactaacctcttaccgttcgttcttcgtacccg

SEQ ID NO: 199749 - DNA, 861 bp, Homo sapiens
  misc_feature: GYAE6OF01AWAN0.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgatactctggctcccagataccaccggagaaattgtgttgacgcagtctccagccaccctgtctttgtctccaggggacagacgccaccctctcctggcgggctagtcagtagtatagtagctacttcttagcctggtatcagcaacgtaaaccgtcggccgtcgggcccgacccgagggtcccttccctactacttaccttaaattaacgttacgtacccttaaagtacggaccggacggggtaccctacggtccgggtcccgtacccgaggtaaccgtacgggttaccgagggttcggacgtagggttcggggtccggttacggggggactaacggtacccgtttaccgacctttcccgtacccaaccctaacgttccgaacggtccaaacgggtaccgttacggggaaccgttaccgttacgggtaaacgtttaacgttttcggaacgttaaggtttaggtttaaattttaggttacggttaaccgtaacggtccgtaacggtacgttaacgttacgttaaccgggtttacccgggttaaccccgttaacccgggtttaaacccgtttaccgggtttttaccggggaaccccgggtaacgggggtttaaacccgaaacgggttccggttaagggaaacggttaaaccgtaaaccggtaaaaccccgggtaaggtttcggggtacgtaccgttaccggtaccctaacccgttacgtttcccgtttcggtttaccccgttaaccg

SEQ ID NO: 199750 - DNA, 812 bp, Homo sapiens
  misc_feature: GYAE6OF01AC1MA.34.22.B11.1.454.CMB.1.raw
  modified_base (196)..(196): a, c, t, g, unknown or other
  misc_feature (196)..(196): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
tcagtacacgtgatcacgaccggtgctcgatttagacgacagctcagggggaggaactgctcagttaggacccagagggaaccatggaaccccagcgcagcttctccttcctcctgctactctggctcccagatactactggagaaatgtgatgacgcagtctccagcccacctgtctgtcgtcccgaaggggaanacgccatcctctcctaggccagggcccaaggtccaaggtacgttacttaacggacctaaaccctaaacgtttacggcccgttagggtaaccccaaggaccaaaaccggtaaaacccgtcgggaccctaaacggaacccttccccggaacgggcctttaccccgtactaattccgttaagtcgggtacgacctactaccccgtaaccgacgggccctacggtacggtacctccccgaggcgtacggttcaggtcggacgtagggttgggtccagggaacctaggttcggttaccacccgtcgtccaaccgtntaccggtaanccgtaacgtctaggaccgtacgttacgtaagtaaagtttcgttttacggaaccgtttaagtttttaccgtacgttacggttacgaacgttacgtaaagttaacgttaaacgtccggttccggggtaacccgttaccgggggttaacccgtcgggaaacccggtaacgggtaccggttaacgggttaacgtaaaccgttaaccgaaaacggttaccgtcgggttaacgacctacggtaacccttaccgtaccttccgtttaccgttgtacccctttaccgttccccgttaaccccg

SEQ ID NO: 199751 - DNA, 653 bp, Homo sapiens
  misc_feature: GYAE6OF01C1NVK.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccgaggggacagacgcccaccctctccgtggccggggccagtcagagtattagtagcttacttcttagcctggtatcagcaagaacctggcctggccgcccaggcctcctcatctataatgcctatgcgaggccagtcggcctacccgagacgtaggttcaggtcggcgaggttcgggtcgtggggctagtacttcacgttcctacaccactcgacgcgagtacgtcggacgtccgtagtaacgttagtttgacttaggttagtttattacttaggtaccgtaaacgttcggtttacggtctaccgtaccgtaacgtaccgggttacgggtaccgtttacggggaacccgtaaacgggggtaaccgtaaggggtaacgtaaaacgtaaccgaaaacgtacgtgggtaccgcgtacggacctaccgtattccgttacgttaccttccgtacttcccgttcccgtaaccg

SEQ ID NO: 199752 - DNA, 732 bp, Homo sapiens
  misc_feature: GYAE6OF01B2GFE.34.22.B11.1.454.CMB.1.raw
  modified_base (304)..(304): a, c, t, g, unknown or other
  misc_feature (304)..(304): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccgaggggacagacgcctaccctctccgtggccggggccagtcagtagtattagtagcttacttcgtacgtccttggtatcgagacagtaaacctggcctggccgcccgaggcctcctnactctataatgcctatcgcgacggccacgtcggcctcccgagacgtaggttcaggtcgcgtaggtcgggtcgtggggacacgtcttacactcgtccactatacgagacgaagtacgtagggacgtaccgtaggtaaacgttagttttacggacgttaagtttaggtttaactttagtttcgtaacgtacgtaccgtaacgtctaacgttaccgaacggtttccggttaacccgtaacccggttttaaacccgttacgggttttaacccgggacccgggtaaacgggggtaaccccgtaaacgggttccggtacgggtaaacggtaaccgtaaaccggtaaaaccggttacggttaccgggttacggacccgttaccgggaacccgttaaccgtacgtttacccgtttccggttaacctttaaccccgg

SEQ ID NO: 199753 - DNA, 885 bp, Homo sapiens
  misc_feature: GYAE6OF01D7Q5Q.34.22.B11.1.454.CMB.1.raw
  modified_base (145)..(145): a, c, t, g, unknown or other
  misc_feature (145)..(145): n is a, c, g, or t
  modified_base (473)..(473): a, c, t, g, unknown or other
  misc_feature (473)..(473): n is a, c, g, or t
tcagtacacgtgatcacgaccggtgctcgatttagacgacagctcagggggaggaactgctcagttaggacccagagggaaccatggaaaccccagcgcagcttctccttcctcctgctactctgctccagactaccgacggaanaattgtgttgacgcagtcctccacgccctacccttgtttcttttcgtcctaccggaggggaaccaggacgcccctacccttccgtcccgtcgggccgggtaccctagtcgaaggtaacgttaagtttaggtacgtcctttaccttttacgttacgtccgttaggttactcgaacgaccaaacgtaaaccgtcggtccgtacgggccgacccgtaggtccctccctactaacgttacctaagtaacttccggtaccttaacgtacggtaccggacgggtcccgtaccgtacggtccccggttaccaaagggtaccgttacggtttacgngggtacggtcgtagggtttcgggtcggtagggaccgtagttacccgttacctacgttacctaccgtaacctacgtaccctaacgtacggtaccgtcggaactaccggttaaggttaagtttacttttacggaacgtttagtttaacgtttaacgttaccgttacggttaacgtacggtttaccggttttacgtcccgtttaaagacccgtaacgtttaccgggttaacccgggttaccgggtacccgggtaaaccgggaaaaccgggttaaccgggtaaaacgggttaagtaaaaaccgttaaccggtaaaaaccggtcgggttacgaccggttcgtaacgacccgttaccgtaccttcgttaaccgtttaccttaccgttacccgttccccgttacccgtctttaacccgg

SEQ ID NO: 199754 - DNA, 832 bp, Homo sapiens
  misc_feature: GYAE6OF01BN60X.34.22.B11.1.454.CMB.1.raw
  modified_base (208)..(208): a, c, t, g, unknown or other
  misc_feature (208)..(208): n is a, c, g, or t
  modified_base (427)..(427): a, c, t, g, unknown or other
  misc_feature (427)..(427): n is a, c, g, or t
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
tcagtacacgtgatcacgaccggtgctcgatttagacgacagctcagggggaggaactgctcagttaggacccagagggaaccatggaaacccagcgcagcttctcttcctcctgctactctggctccagataccaccggagaaattgtgttgacgctagtctccagccacctgtctttgtcctcgaggggtacagacgcctaccctntaccgtcggccggggtccagtcacggtagttagttaagtacgtcgttactttcgttagtccgtaggttactacgtaagaccgtaaagaaacccggtcggaccgtcgggccgtacccgtacggtacctccctacgtacttacctagtaaactccgtacttaagtacggacggtacgggacctacggtcggtcccgttaccaacggtaccgtacggttacngggtacggacgtagggtcgggtacggtaggggtactaaggtaactcccgtactccgtactacctactcgacgccgcgtaccgtntaccgacggttntaagggtaatttacgggtttcgaactttaacggtttttacgttaccggttagttacccgtagtaaccgtttaacgggtttaaactaaaccgggtttaaccggggttccgggttaacccccggggttaccggggttaccgggtttaacccggaaacccgggttaaccgggttaaccgggtaaagggttaaccggaaacggttaaccggaaaacggtaccgggttacggtggttactaacccgggtacggtcccttaaaggtttcccgtaacgttccgtttaacccaccgtttccccgtaccggtaaaccc

SEQ ID NO: 199755 - DNA, 685 bp, Homo sapiens
  misc_feature: GYAE6OF01BIXR2.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaacctggcctggcgccaggctcctcatctataactgacctatagcgacgggccacgtcggccgtccagacgtaggtcaggtcgcgtaggtcgggtcgtggggctagtccttcgactctacgaacctatcgacgtacgagtacgtaggacgtccgtaggtaaacgttagttttcggacgttaggttagttattttagtttcgtacgtaacgcgtaagactaatccgtaacggttccggtacccgtaaccggtttaaccgttacggtttttaccgggaccccggtaacggggtaacccgtaacggtaccgttaacgggaaccggttaacgtaacccgtaaaacgggttacccggttcggtaacgggttaccgtaacggttacccgtaacccgttacgttaccggttcgtttcccgtttaacccccgg

SEQ ID NO: 199756 - DNA, 876 bp, Homo sapiens
  misc_feature: GYAE6OF01BN98L.34.22.B11.1.454.CMB.1.raw
  modified_base (164)..(164): a, c, t, g, unknown or other
  misc_feature (164)..(164): n is a, c, g, or t
  modified_base (458)..(458): a, c, t, g, unknown or other
  misc_feature (458)..(458): n is a, c, g, or t
tcagtacacgtgatcacgaccggtgctcgatttagacgacagctcagggggaggaactgctcagttaggaccagagggaaccatggaaacccagcgcagcttctcttcctcctgctactctggctcccagactaccacggagaaattgtgttgacgcagttccnccagccctaccttgtctttcgtcctccgagggacagcgacccacctctccgtcggccggggtccaggttccagtaggtttattaggtacgtcttactttccttacggccgtttaggtactcagacgtaacggaaaccgtcggaccgttcggaccgcccgaacggtccttacctacgtacttacttaactaaacgttcgtacctagttacgaccggtaccgggtcctaaccggttcggacccgtttacccgaacggtaccgttacgggttttacgaccggggttacgggaaccgnggggttttacggggggttccggtttcggggggggaccctaaacggtttacccgttttaaccctaccgttacccgtacccgtaaacccgttacgtccgaaacggtaccggtaaccgtaccgggttacggaaccggttaccggttacggttaaacgggttttccgtttaggtaccgttaggttttaagtttactttaggtttacgtacctaaggcttacggactacttccgtacggttaccggttctaacccgggtttaccgtttaacgggttttccgggaaccgggttaacgggtaaccgtaaagggtccggttagaaccggtttaacgtaaacccggttaaacgtaaccggttacgggtacggttacccgttaaccgtaccgtaacccgttattccccggttgttaccgtttaacccg

SEQ ID NO: 199757 - DNA, 706 bp, Homo sapiens
  misc_feature: GYAE6OF01BK4RE.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctccagataccaccggagaaattgtgttgacgcagtctccagcccaccctgttctttcgtctccgaggggacagacgccaccctctcctggccggggccagtcagagtattagtagcttacttctagcctaggtactcgacgtacaacgtaaccgtggtccgtcggccgccgacggtcctcctacacgttctaataactcgtactacgtacgaccgacggacctacgtcggtccgtaccgagtacgtaggttccaggtcggcgtaggtcgggtcgtggggacagtactcaccgtcctacacctaactacgacggacgtaacggtacgtacgggtacgaccgttaaggtaaacgttagttttacgacgttagttagttaagtttagttacgtacgtagtacgtacaacgtacgtacgaccgtttaccggtaccgtaaccggttaccgttacggttttaccgggaccggtaaacgggaaccgtaacggtctaagggtaacggtaacgtaaaccggtaaaacggtacgttaacgggtacgtacgtaaccggtaccaaccgtacgtttcgttcgttccgttaccc

SEQ ID NO: 199758 - DNA, 836 bp, Homo sapiens
  misc_feature: GYAE6OF01DN100.34.22.B11.1.454.CMB.1.raw
tcagtacacgtgatcacgaccggtgctcgatttagacgacagctcgagggggaggaactgctacagttacggaccaggacgggaaccagtacggaaacccaggcgcacgtcttctccttcctctagcttactcgtcggcctaccgatactaaccgacggtaataagttggtgttcgacgctagtccaccgacgtccctacttgttctttcgcgacggagggacacgacacccgcccttcgccggtacgggccggtaccaggtacgtacgttaagttagttacgtacgttcctttacgttacgttaacggtcgttagggtactagaacgtaacgaacgtaccggtcgtccggacggccgtaccggtgtcctactactactactaaggttactacgtacgtaacgtacggaccggtaccggtacctaacgggtcccgtaccggttacgaacgggtacggtacggttacggcgggtttacggaggtacggttcggggacgtacggggtactacggttcctccgtactacaccgtacgacgtccgtaacgtacgacgtacggacgtacgtacggtacggtttaacgttacgttacgggtacttacggtttaagttacgtttaacgttcggtacgtacgttaccgtacggttaacctacggttaccggtaaccgttaccgggttaaccctccgggttttaccggttaacgggttaccgggtaaaccggtaaccggtaaccgggttacggtaccggtaaggtaaacttacggtaaaaccggtcgttaacgggtcgtaccgacgtacgtacctacgttacgtacgttccgttaccttacccgg

SEQ ID NO: 199759 - DNA, 516 bp, Homo sapiens
  misc_feature: GYAE6OF02GBDEU.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtgttaatagcatctacttagcctggtaccagcagaaacctggccagcctcccagactcctcattaatggtgcatactacagggcccctggcatcccagacaggttcagtggcagtggtctgggacagacttcactctcaccatcaccagactggagcctgaagtattttgctagtgtattactgtcaactagttgtctcacacacgtggacgttcggaccgaagggaccaaggtgaaatacgaaacgtacgtagtacggctgacacatctgtcttcatcctccgctatcg

SEQ ID NO: 199760 - DNA, 520 bp, Homo sapiens
  misc_feature: GYAE6OF02IDPO4.34.22.B11.1.454.CMB.1.raw
  modified_base (488)..(488): a, c, t, g, unknown or other
  misc_feature (488)..(488): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgccaggctcctcatctatggtgcatccaccagggccactggtatcccagccaggttcagtggcagtgggtctgggacagaattcactctcaccatcagcagcctgcagtctagaagtatttgctagttttattacttgtcagctaagtataataactggaccgtccgggacgttcggaccgaagggaccaggtaggaattacgaacgacgtggngtctgctacatctgtcttcacttcctccgtac

SEQ ID NO: 199761 - DNA, 508 bp, Homo sapiens
  misc_feature: GYAE6OF02G3A0U.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggttcagtggcagtggggtctgggggcagacttcactctcaccatcagcagactggagcctgaagtattttgactagtgtatttagttgttcagcagcatcatccggtcaccgttactacttttggccgagggaccagctaggagagtcaaacgactgtggctgccaccatctagtcttac

SEQ ID NO: 199762 - DNA, 498 bp, Homo sapiens
  misc_feature: GYAE6OF02GR6U9.34.22.B11.1.454.CMB.1.raw
  modified_base (479)..(479): a, c, t, g, unknown or other
  misc_feature (479)..(479): n is a, c, g, or t
  modified_base (494)..(494): a, c, t, g, unknown or other
  misc_feature (494)..(494): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtgttagcagcaacttggcctggtaccagcagaaacctggccaggctccaggctcctcatctatggtgcatccaccagggccactggtactcccagccaggttcagtggcagtggtctgggacagaattcactctcaccatcagcagcctgcagtctgaagattttgctagtttatactgtcagcatatataactgcctcgggacgttcgcgaggacaaggtgaatcgaacgacgtgtggctgaccacattcgngtcttcactcttccnctac

SEQ ID NO: 199763 - DNA, 502 bp, Homo sapiens
  misc_feature: GYAE6OF02G44P7.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggttcagtggcagtgggtctggggcagacttcactctcacatcagcagactggagcctgaagattttgcagttgtattattgtctagcagcatcatcgtcaccgtactacttttcggccgtagggaccaagcgtaggagagtacaaacgaactgtggctgcaccatctgtcttac

SEQ ID NO: 199764 - DNA, 561 bp, Homo sapiens
  misc_feature: GYAE6OF02GA41P.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctgtctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccacgtggccgtcccagacgaggttcagtggcaggtgggtctggggcagtctcactctcaccatcagcagctaggagcctaggaagtatttgacgtagttagtatttagttgtcgagcagtcatctagtccgtcctaaccgtacttacgtttcggaccgtaacgggaccgtaagcgtaggaacgtaacgtaacgaaacggtaacgtcggtacgtacgtacgtacctaccgtagtccgttacgttccttaccg

SEQ ID NO: 199765 - DNA, 551 bp, Homo sapiens
  misc_feature: GYAE6OF02IILNE.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggcagagccaccctctcctgcggggccagtcagagtattagtagctattcttagcctggtatcagcagaaacctggcctggcgcccaggctctcatctataatgcctatagcagggccacgtggccgtcccagaccgtaggttccaggtcggcgtaggtggggtctgggggcaggtacttcactctcacatcagcagactggagctagaagtatttgactagtgtattattgtcagcagtacatcgagtcgtacaccgtactacgttttcggaccgtagggaccaagtcgtaggaacgacgtaacgtaaaccgtaacgtacggtaggacgtcgacctaacctactacgtcgttacttaccg

SEQ ID NO: 199766 - DNA, 576 bp, Homo sapiens
  misc_feature: GYAE6OF02H60BX.34.22.B11.1.454.CMB.1.raw
  modified_base (409)..(409): a, c, t, g, unknown or other
  misc_feature (409)..(409): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcagggccagtcagagtgttggcagcaacttagcctggtaccagcagaaacctggaccaggctcccagagtcctcatctatgctacactcccacaggccactgctattccagccaggttcagtggcaggtgggtctgggactaggagttcacgtctcacctatcagactagccctggcctagtctaggaagtacttcgngtacttaactttagttacttgtactagctaagttcttaaagtaaggtcggtaccgtagggtaccgttacgggaccgaaacgggaaccgaagggtacgtaaacgtacgtaaacggaacgtggtaggccgttacgaccgtaccatcgttacgtctttaccatttccccg

SEQ ID NO: 199767 - DNA, 497 bp, Homo sapiens
  misc_feature: GYAE6OF02FFGFF.34.22.B11.1.454.CMB.1.raw
  modified_base (388)..(388): a, c, t, g, unknown or other
  misc_feature (388)..(388): n is a, c, g, or t
  modified_base (455)..(455): a, c, t, g, unknown or other
  misc_feature (455)..(455): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtgttagcggctacttagcctggtaccagcagaaacctggccaggctcccaggctcctcatctatgatgcgtccaacagggccactggcatcccaggcaggttcagtgcagtggtctgggacagagttcactctcacccatcagcagtctgcagtctgaagtntttgctagtttatactgtcagtcactataatagtgcctcgatcaccttcgccaaggacagactgganaattaacgaactgtacgctgacaccatctgtcttcattcccg

SEQ ID NO: 199768 - DNA, 517 bp, Homo sapiens
  misc_feature: GYAE6OF02F9OEN.34.22.B11.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagtacacgtgatcacgaccggtgctcgatttagacgacagctcagggggaggaactgctcagttaggacccagagggaaccatggaaaccccagcgcagcttctcttcctcctgatactctggctcccagataccaccggagaaattgtgttgacgcagtctccagccaccgtgtctgtgtctccaggggaaagngtcaccctntcctgcagggccagccagagtgttagcagcaacttggcctggtaccagcagaaacctggccaggctcccaggctcctcatctatggtgcatccaccagggccatggtactcccagccaggttcagtggcagtggtctgggacagaattcactctcacatcagcagcctgcagtctgaagtattttgctagtttattactgtcagtctagtataataactggaccgtcgggacgttcggaccgaagggaccaaggtgaacgttacaacgtactggtggactgacactatctgtcttctacttcctccgtacc

SEQ ID NO: 199769 - DNA, 553 bp, Homo sapiens
  misc_feature: GYAE6OF02GG34U.34.22.B11.1.454.CMB.1.raw
  modified_base (388)..(388): a, c, t, g, unknown or other
  misc_feature (388)..(388): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagcccaccctgtctttgtctccaggggacagagccaccctctcctggcggggccagtcagagtattagtagctacttcttagcctggtatcagcaagaaacctggcctggcgcccaggcctcctcatctataatgcctatagcagggccactggccgtcccagacaggttcagtggcagtgggtctggggcagcttcactctcaccatcagcagactggacnctagaagtatttgactaggtagttatttagttgtcgtagtcagctagtcagtccggtctacccgtacttacgtttcggaccgagggaccagtcgtaggacgtacgtaacgaaacgtacgtggtcgtacgtacgacctaaccgtagttccgttacgttccttaccg

SEQ ID NO: 199770 - DNA, 694 bp, Homo sapiens
  misc_feature: GYAE6OF02HK50J.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtcctccgaggggacagagcccaccctctcctgccggggccagtcagagtattagtagctacttcttagcctggtatcagcagaacctggcctggccgcccgaggcctcctcatctaataatcgacctatagcagggccacgtcggccgtcccagaccgtaggttcaggttcggcgtaggtcggggtcgtgggggacctaaggtacctttcgaacttcctaccgaacccgtacttccgaagtccaagtaccgttcgggacgtaccgttaggaaagttagttttacgacgtaggttagttatttagttcgtactacgtacgagtactaacgtacgtaacgttccggttaccgtacccgtttacgttaccggtttttcggaaccccggtaacggggtaacccgtaacgggtaccgtagggtaaccggtaacgttaaaccggaaaccggtacggttacggtaccgggtacttaccggaccgtaaccgtacgtttccgttacgttccgtttaacccg

SEQ ID NO: 199771 - DNA, 506 bp, Homo sapiens
  misc_feature: GYAE6OF02IUUTM.34.22.B11.1.454.CMB.1.raw
  modified_base (494)..(494): a, c, t, g, unknown or other
  misc_feature (494)..(494): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccactggcgtcccagacaggttcagtggcagtgggtctggggcagacttcactctcaccatcagcagactggagcctgaagtatttgcagtgtattactgtacaactagttggtctcacacacgtggacgttcggcgaacgggacaaggtagaatacaagactagtggctgcaccatctgtcttnactcctccgtcc

SEQ ID NO: 199772 - DNA, 644 bp, Homo sapiens
  misc_feature: GYAE6OF02JKB37.34.22.B11.1.454.CMB.1.raw
  modified_base (374)..(374): a, c, t, g, unknown or other
  misc_feature (374)..(374): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagacgccaccctctcctggcggggccagtcagagtattagtagctacttctagcctggtatcagcaagaacctggcctggccgccaggctcctcatctataatcgacctatacgcgagggccactgggcctacccagactagggtcaggtggcctaggtcgggtctgggacagtacgtcnctactcaccatcaaccagtactaggacgccgtagtaagttactttgacgtagttaggttaacttactaggttacctaacgtacggtttcggtactaccgtacaaacggtacgtacgggtaccggtttcggaaccggtaaaccggggtaaccgaagggttaaacggtaaaactaacgaaaaccggtacgtaacggtcgggacgtacgaccgtaaaccgtacgttccgtacgtttacgttacctacgttacccgttcccccggtataacccg

SEQ ID NO: 199773 - DNA, 665 bp, Homo sapiens
  misc_feature: GYAE6OF02HAQ2T.34.22.B11.1.454.CMB.1.raw
  modified_base (299)..(299): a, c, t, g, unknown or other
  misc_feature (299)..(299): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcagggtcagtcagcgttctaacaccgacttcttcgcctggtaccagcagagacctggccaggcctcccaggcctcctcatctttggcncgtccaccgagggcccagtcggcactcccagacaggttcaggtggcaggtggtctggggacaggtacctttcgacttcctcgaaccatccagtccaaggtaacttggacgtacccgttaggaaacgttagttttgacgtaacgttaattaacgtttacgttgttacctagactaaattaactacggaacggaccgcgtaacgttcgggtagggttcccggttaccgggacccgggtaaacggggaacccgtaaaggggtacggtaaacgtaccgaaaacggtaaccgttaggtacgggtaccgtacgaccgtaacccgttacgttcgttacgttaccctttaccgtacgtttccccgttaccccgg

SEQ ID NO: 199774 - DNA, 617 bp, Homo sapiens
  misc_feature: GYAE6OF02GUZIT.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccgaggggacagacgccaccctctcctggcgggccagtcagagtattagagctacttcttagcctggtatcagcagaaacctggcctggccgcccaggcctcctcatcctaataactcgcctagtacgcagggccacgtggccgtccaggaccgtagggttcaggtcggacaggtgggtcgtggggcaggtacttcgactctcaccatcgagtacagacgtaggacggtccgtaggtaagtagtttgacgtagttagttatttagttcgtacgagtcgagtactactacgtacgtacggtaccgtaccgttacgttacgttttcgggaccggtaacgggtaaccgtaacggacgtacggaacgtaacgtaacgtaaacgtaacgtacggttacggacgtcgaccgtaccgtactacgttacgttccttaccg

SEQ ID NO: 199775 - DNA, 560 bp, Homo sapiens
  misc_feature: GYAE6OF02F9TQJ.34.22.B11.1.454.CMB.1.raw
  modified_base (363)..(363): a, c, t, g, unknown or other
  misc_feature (363)..(363): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagcccaccctgtctttgtctccaggggacagagcccaccctctcctgccggggccagtcaggagttattagtagctacttcttagcctggtatcagcagaacctggcctggcgccaggctcctcatctataatgcctatagcacgggccactggctccagactggttcagtgcagtggtctgggcagacttcactcncaccatcagcagacgtaggagctgaacgtagtttgactagttgtatttattgtctagcgagctatctacgtcgtacgtaccgttacttaccgttttcggaccgtaacgggtacctaaggccgttaggaagtacgtaacgaaacgtaacgtaggtacggacgtcggacctaccgtagttccttacggttacttacccg

SEQ ID NO: 199776 - DNA, 580 bp, Homo sapiens
  misc_feature: GYAE6OF02HFQOK.34.22.B11.1.454.CMB.1.raw
  modified_base (287)..(287): a, c, t, g, unknown or other
  misc_feature (287)..(287): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctnatctataatcgacctatagcacgggccacgtcggccgtcccagacgtaggttcaggtggctaggtcgggtcgtggggcagtcttcactctcacatcagcagacgtggacgtccgtaggtaagttagtttgactaggttattaagtttattcgtacagtcgacgtctactcgtacttccggtactaccgttacttacgtttcggaccgtacgggaacctagtcgtaggacgtaacgtaacgaaacgtacgtacggtacgcgtacgaccgtacctacgttcgttacgtcttaccg

SEQ ID NO: 199777 - DNA, 570 bp, Homo sapiens
  misc_feature: GYAE6OF02G60KA.34.22.B11.1.454.CMB.1.raw
  modified_base (464)..(464): a, c, t, g, unknown or other
  misc_feature (464)..(464): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgccaggctcctcatctataatgacctatagcagggccacgtggactccagactaggttcagtcggctaggtgggtacgtgggggacctaaggtaccgttacacgttctaccgacctaagtccgagtaccgtaagacgtcggagtccgtagaagtagtttacgacgtagttcgtaattacgttagtacagnagctatcagtacgtcacgtactacgtttacgcgtagggacaacgcgtagacgtagtaacgaaacgtacgtcggtacgtcgtacgacacgtactcgtgttcgttacg

SEQ ID NO: 199778 - DNA, 549 bp, Homo sapiens
  misc_feature: GYAE6OF02JAPW4.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagcctggtatcagcagaaacctggcctggcgcccaggctcctcatctataatgcctatagcagggccacgtggccgtcccagaccaggttcaggtggcaggtgggtctggggcagacttcactctcaccatcagcagactggacgcctagaacgtattttgactagttagtattattgtcagcagctatcagtcggtactaccgtactacgtttcggaccgacgggtaaccagtacgtaggagtacgtaacgaaacgtaacgtggtacggtcgtacggacctaccgtactacgttcgtcttaccg

SEQ ID NO: 199779 - DNA, 593 bp, Homo sapiens
  misc_feature: GYAE6OF02GGQ6R.34.22.B11.1.454.CMB.1.raw
  modified_base (288)..(288): a, c, t, g, unknown or other
  misc_feature (288)..(288): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctcagccacctgtctttgtctccaggggacagagccaccctctcctggcgggccagtcagagtattagagctactcttagcctggtatcagcagaactggctggcgcccaggcctctcatctatancgcctatgcaggccacgtggctccagactacggttcaggtcggacaggttgggtccgtgggacaggtacttccacgttcctcgacacgtcaagtccaagacgtgggacgaccgtaggtaagttagtttcgacgtagttaggttattaacgtttcgacgtacgtcagtacaacgttctagtcggtacctacccgtaacttaccgttttgggacccgtaaggggacctacgacgttgaacggtacgtacgaaaccgtaacggtcgtacggtactcggacctaccgacgtccgttacgttcttacccg

SEQ ID NO: 199780 - DNA, 849 bp, Homo sapiens
  misc_feature: GYAE6OF02G95RG.34.22.B11.1.454.CMB.1.raw
  modified_base (200)..(200): a, c, t, g, unknown or other
  misc_feature (200)..(200): n is a, c, g, or t
tcagtacacgtgatcacgaccggtgctcgatttagacgacagctcgagggggaggaacgtgctcagttacggacccaggagggaaccatacggaaaccccagcgcagcttctcttcctcctgctactctgcctccagataccacggagaattgtgtgacgcagtctccagcccaccctgtctgtcgccccgaaggggaanacgcactcctctctagcgacgggctagtcagtagttattacgaccaacctaacttacggtacccgttacgggtaacccaagaccgtaaacgaaaacccgtcgggacccaacgaacccgtcccgaacgggtcccttacccactaacttaccgttaacggtggggttaccgacctaacttaccccgaaacccggacggggtacccctaacggttcggtaaacctcccccggaagggtccgtaacgggtttaccgagggttcggaccggttaggggtcgggttcgtacgggggtaacaacgggtacgtttacccaacgttcccttaccaaaccctacgtcgaaccggtaccgtaggttcccgtaggacctaaggttaccgtaggtaaaaccgttttagttttacgacgttttaaacggttttactttaccgttgtaccgtaacggtactaaaccgttaattaaacgtaacgggttccgtacccggttaccaactttacccgtacccggttaacccgggaccgtaaacgggaaaccgtacgtaaccgggtaggtaacgtaaacgttaaacccgggtacgttacgggtccgtaacggtccgaaccggttacctacgttaccgttcggtttaccttaccggacctttttcccccg

SEQ ID NO: 199781 - DNA, 700 bp, Homo sapiens
  misc_feature: GYAE6OF02GCU3X.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagatatcaccggagaaattgtgttgacacagtctccaggcaccctgtctttgtctccgaggggaaagagccaccctctcctgcgagggccagtcagagtagttaatagcatctacttagcctaggtaccagcaacgaacctggaccacgccctccagaccttcctactaattaagtgggtcgacctaagttaacctaaccgaccggggcccctggacctaccgtacccgaagaccgtacgggttccaggtcggactagggtgggtcgtagggactaggtacctttacgacttctaccaccactacccaaccgagtacgtcggtacgaccgtaggtaacgttagttttcggactaagggttacgttaactttaacgtcgttaaccttaacgtacggtttacggtacctaccgtaccgtaaccgttacgggttacgggttaccgggttaccgggaaccggtaacggggtaaccgtaaagggtaacggaaacgtaacgtaaaccgtacgttgggtacgtcgtacgtacctactacgttacttacgttcttacctacttcccgtaccctctacg

SEQ ID NO: 199782 - DNA, 518 bp, Homo sapiens
  misc_feature: GYAE6OF02FJ6TN.34.22.B11.1.454.CMB.1.raw
  modified_base (490)..(518): a, c, t, g, unknown or other
  misc_feature (490)..(518): n is a, c, g, or t
tcagtacacgtgatcacgaccggtgctcgatttagacgacagctcagggaagggggctgcagtggattggagaagtctttcatactggaagcaccaactacaacccgtccctcaagagtcgactcgccatatcaatagacaagtccaagaacgttttcaccctgaaccctgagctcagtgaccgccgcggacacggccgtctattactgtgcgagagataagggaacggaaactcgaccctccccctcgaactcgtggggccgaggccacccgtggtccactgtcctcctcacgcctccaccgacggccccatcccggtccttcccccgtggccctacccctcctacccaagcgcctacccttcggcggggaccacgcggccggcccgtcgggcctcggccgtcggtaccaacgggtaccctaacgttcccaatccgtacgtcgttaccgtaggacggcggggctcgggaccgaagggccgactagtagnnnnnnnnnnnnnnnnnnnnnnnnnnnnn

SEQ ID NO: 199783 - DNA, 706 bp, Homo sapiens
  misc_feature: GYAE6OF02G6Q3P.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctccagataccaccggagaaattgtgttgacgcagtctccagccaccctgtctttgtctccgaggggacagacgccaccctctcctggcgggccagtcagtagtattagagctacttctagcctggtatcagcaagtaacctggacctcggcccgccgaggtcctaccctcgtacttactaattaacgtcgtacccttaatacggaccggaccggggaccctacggtccgggacccgtacccgaaggtacggtaagggtttccaagggtcggcgtaacggggttcggggtacggcggggtacgaacggttaccttaccgaccgttaccctacctaaccgtactaccgacggactaacggtaccggtaggtaccggtaaccggttaggaaaacgtttcgttttacgcgttagtttacggtttaatttacggttcttaacgagtaccaggtactacgtacgtacttaccggtacctaccgttacgttacgttacgggtaccggaacgggtaaccaggtacgtaggactacgtaacgaacggtactagtacgactcgaacctacgtacgtcttctaccgttacc

SEQ ID NO: 199784 - DNA, 702 bp, Homo sapiens
  misc_feature: GYAE6OF02HZAYZ.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccgaggggacagagccaccctctcctggcgggccagtcagagtattagagcttacttctagcctgtatcagacgaacgaaaccgtggccgtcggccgacccgaggtcctcctactattactaaattaacgtcgtaccttaaggtacggacggaaccgggaccctacgtacgggtacccgttaccgaagtacgtaggttcgaggtgggcgttagggtcggggtacgtggggactacgttactacactcctaccactaacgtacgagtacgacggtacgtacggtaacgtacggttaagtaagttttagtttcgacgttaagtttacgttaattagttacgtacgaacgtcgtaagtactaacgttacgtaccggtaccgttaacccgtacggtttaccgttacggttaccgggaaccgggtaaaggaaccgtacgtacggtagtaacgtaacgtaaacggaaccggttcgtgtaccgaccgtacgtacccgtacttacttcgttaccgtcccttaacg

SEQ ID NO: 199785 - DNA, 660 bp, Homo sapiens
  misc_feature: GYAE6OF02H7U7X.34.22.B11.1.454.CMB.1.raw
  modified_base (213)..(213): a, c, t, g, unknown or other
  misc_feature (213)..(213): n is a, c, g, or t
  modified_base (390)..(390): a, c, t, g, unknown or other
  misc_feature (390)..(390): n is a, c, g, or t
tcagtacacgtgatcacgaccggtgctcgatttagacgacagctcaggggggaggaactgctcagttaggacccagagggaaccatggaaacccccagcgcagcttctcttcctcctgctactctggctcccagataccaccggagaaattgtgttgacgcagtctccagcccaccctgtctttgtctcgaggggacagagccaccctctccngcgggccagtcagagtattagtagtctacttcttagacctggtatcagcagaaacctggtccgtggccgacccgaggtcctccgtcacttctattaactcgacctagtacgccgacggcctacgtggtaccgtacccagacgtaggttcgaggtcggcgaggtgggtcgtggggacngtacttcgactcgtaccaacactcgacgtcgacgtagtcggtactacgtaggtaaagttgtttagacgtgtttagtagtttagttcgtacgacgacgtacgtactacacgtaccgtttaccgtaccgtaacccgttacgtttaccggtttaccgggacgggaaccgggtaacgtaccgcgttagggtaacgtacgtaaacggtaaacggtaacgttacggtaggtaccgttacggaacccgtacttaaccggtcttacgttcgttaaccg

SEQ ID NO: 199786 - DNA, 824 bp, Homo sapiens
  misc_feature: GYAE6OF02HUDOL.34.22.B11.1.454.CMB.1.raw
tcagtacacgtgatcacgaccggtgctcgattttagacgacagctcagggggaggaactgcgtctagttaggacccagagggaaccatggaaaccccagcgcagcttactcttcctcctgctactctgcctccagataccgaccggagaattgtgttgacgcagtctccagccaccctgtctttcgctcgagggacaggacgcccaccgtctccgtgccgggccagtcagtagttagttagtagtctacgttctacgtcctggtatcgagacacgtaaaccgtcggtccgtggtccggacccgcggccttccgtccaacgtctaagtaacgtcgtaccgtagtacggcgacgggcctacgtcggcctaccgacggacctacggttacgagggttcggaccgtaggtcgggtacggtcggggtacgtaggtaccttcgacttccgtaccaccgtacgtccgaacgtaccgtacgtaaccgttcgggaaccgtaccggttaggtaaacgtttcgtttacgggacttacgggtttacgttaacgtttaccggtttcggaaccgtaacggtaccgtacgttaccttaacgtttaccgtaccgggtttaccgttaacccgtaccggttttaaacccgttttaacgggtttttacccggggtaaacccgggtaaaccgggggttaaaccgtaacggggtccgggtttaacgggtaacgggttaaaccgttaacccggttaaaaccggttaacgggttcgggttaacggttaccgttaacggttaacccggtacctaaccggtttaccggttacgtttaccccgtttaccg

SEQ ID NO: 199787 - DNA, 688 bp, Homo sapiens
  misc_feature: GYAE6OF02JATWQ.34.22.B11.1.454.CMB.1.raw
  modified_base (206)..(206): a, c, t, g, unknown or other
  misc_feature (206)..(206): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
tcagtacacgtgatcacgaccggtgctcgatttagacgacagctcaggggggaggaactgctcagttaggacccagagggaaccatggaaaccccagcgcagcttctcttcctcctgctactctggctccagataccaccggagaaattgtgttgacgcagtctcagccaccctgtctttgtctccgaggggacagagccaccctntcctggcgggcagtcagatattagtagctacttcttagccgtgtatcagactagaacctggcctggcgccaggcctctcatctaatatcgctatgnaggccacgtcggcctaccagactaggttcaggtgctaggtcggngtcgggcaaggtctacgactctacgaccctatcgacgtacgaagtacgttacggacgtaccgtaggtaaagttacgttttacggacgtaaggtttagttaacgtttaaggtttacgttaacgtaacgtaccgtaaaggtacctaacgtaccctaaggttacccggtaaccgttaacccggtttaacgttaccgttttaacgggaccggtaaaccggggtaaccgtaaacggtaccggtagggtaacgtaaacgttaacccggtaaaacggtaacgttacgggtaccggtaccgttaacgacccgtaacccgttacgtacctttacggttaccttttaacccg

SEQ ID NO: 199788 - DNA, 696 bp, Homo sapiens
  misc_feature: GYAE6OF02GR7XM.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcgggccagtcagagtatagtagctacttctagcctggtatcagcagaacctggcctgcgcccaggctcctcatctataactgacctaatgcgagggcccacgtcggccgtacccagacctaggttcaaggtggccgaggttcggggtctagggggcaacgtacgtttcaaccgttctaccgtaacccattaccgacggacaacggtacgttagggacgtaccgtaggtaaacggttacgtttttcggacgttaacggttaggtttaacgtttacggtttacgtacgttacggtacgtaacggtacctaacgttaccgtaacgttaccggttaccgtaacccggtttaccttaccggtttttacgggaccgtaaccggggtaaccgtaacgtcggtagggtacgtaacgtaaccgaaaaccgttacggttaggtacggtaccgtcggaaccgtaccgtaacgttaccgttacggttactttaaccg

SEQ ID NO: 199789 - DNA, 573 bp, Homo sapiens
  misc_feature: GYAE6OF02HRX00.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagtattagtagctacttcttagctgtatcagcagaaacctaggcctggcgccccaagggttcctcgatctataaatcgcctattagcagggccacctggccgtcccagacaggttcaggtggcagtgggtcgtggggcagactttcaacgtctcacccaatcagtcagacctggacgccgtgtaagagttttgactagtgttaattattagttcagtcagcatcatacggtcaccgtacgtacttttacggccgtaaggggtacccgaaacgtcgtagggtacgagtaacgaaacggtaacctaggtaggtaccgtagaccgtacgacttctacgttcttcttaacccg

SEQ ID NO: 199790 - DNA, 713 bp, Homo sapiens
  misc_feature: GYAE6OF02G7TIL.34.22.B11.1.454.CMB.1.raw
  modified_base (389)..(389): a, c, t, g, unknown or other
  misc_feature (389)..(389): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctccagactaccaccggagaattgtgttgacgcagtctccagcccaccctgttctttgtctccgaggggacagacgcccaccctcgtccgtggccgggccagtcaggtagttagttaggtagccttactttacttacgtcctggtactcgagacgaacgaaccgtcggaccgtcggcccgacccgacggcctcccgtctactctataatcgtacctagtacgacgacgggccacgtcggccgtacccgagtaccgtaggttcgnggtcggtacgtaggttcgggtcggtcggggacacgttaccgttcgtacttcctacctacctacgtccgagaccgacggtacggtacggaccgtccgtaaggtaagtttacgttttcgacgttaggttactttaagtttacggtttcgtacgtacgtaccgtcgtacctacgtaccgttacggttacccggtacctaacccgtttacgttaccgtttaccggaccggttaacggaaccgtacggtcgtaggacgtaacgtaaccggtaaacgtacgttcgtacggtacgtcgaccgtaccgtcgttccttacggttccttaaccg

SEQ ID NO: 199791 - DNA, 837 bp, Homo sapiens
  misc_feature: GYAE6OF02HM58Z.34.22.B11.1.454.CMB.1.raw
  modified_base (193)..(193): a, c, t, g, unknown or other
  misc_feature (193)..(193): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctccagataccacggagaattgtgttgacgcagtctccagccaccctgtctgtgtctccgaggggaanacgccacctctcctgcgacgggccagtcagtagtgttggacagctaacgttgcctggtaccagcaagaaaccgtggaccaaggcctcccgagacgtcctacgactctatgacctacactcccaacgacgggtccacgtgtacttactccgagtccgtaaggttctacggtggtaccgtagggttcggggttaccgtacggggacgtaacggtacggttcctaccgttccgtacccgtaacctagttaccgaacggtaccgtaacgcccgtttaggaccgtaaggttacccgtaggtaaaacgttcgttaccggtacggttacctttaacgtttttaaacgtttacgttacggttaccgtaaacggttccgtaaacgtttaaccgttaaaaggttaaaccggggttccggggttaaccccggtttaggggttaaccccgggtttaccgggtaaaaccgggtaaaccggggtaaaccgttaaaacgggggttaaccggttaaaacgttaaacccgggtaaaaaccggtttaaacccgggttgggtaacccggggtttaccgaaccggttaaacccgtaaccggtaaaccgttttcccggtttaaccgggttttacccttaacccggttacccttttaaccccccgg

SEQ ID NO: 199792 - DNA, 816 bp, Homo sapiens
  misc_feature: GYAE6OF02HD04R.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccacctgtcttgtctccaggggacagacgccaccctctcctgcggggccagtcagtagtacttagtagctaacttcttagcctggttaatcagcagaaacctggcctggccgtcccgaggtcctacgtccattacctaattaactcggtaccctaagttacggaccgtaacggggaccctaacgttcgggacccgttaccccgaagggtaaccgtaacgggtttcccgaaaggttcggggtaccgtaacgggttcggggggttaccgttcggggggggacctaacggtacccgtttaccgaaccggtttcctacccgtaacccgtaacgttaccgacggtacgtacggtaacgtcgggtacgtaccgtacggtaacgttagttttcgacgtacgttagttactttaattcggtacttagacgtacgtacaattccgaacttccgggttaaccctaaccgttaaccgtttaaccggtttttaccgggacccgggtaaacggggtaacccgtaacggggtacccggtttagggaacggtaaccgttaaccggtaaaacccgggtaaccgttacgggttaccgggtaccgttacccggtaccgtaaaccccgtaacggtttacccggttacggtttcccttttaaccccgg

SEQ ID NO: 199793 - DNA, 587 bp, Homo sapiens
  misc_feature: GYAE6OF02GYAI3.34.22.B11.1.454.CMB.1.raw
  modified_base (429)..(429): a, c, t, g, unknown or other
  misc_feature (429)..(429): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccagccaccctgtctttgtctccgaggggacagacgccaccctctccgtggcggggccagtcagtcgttctaacaccgtacttcttcgcctggtaccagcagagacctggccaggcctcccaggcctcctcattcgtttggtcgccgtccaccgacgggcccacgtggccactccccgagacctaggttcaggtcggctaggtcgggtcgtggggacaggtaccttcactctcaccatcacgcagacttgacgtcctagaagttntttgactagttattattacgtgtacagtactaatacgtacgacgacgtctacgtggtcgggtcgttcggacgtaacgggaccgaaggtagaactacgaacgtacgtggtcgactcgactacgtagttcgtcgttaccttactacttccgtcccgtacg

SEQ ID NO: 199794 - DNA, 629 bp, Homo sapiens
  misc_feature: GYAE6OF02FFS4K.34.22.B11.1.454.CMB.1.raw
  modified_base (153)..(153): a, c, t, g, unknown or other
  misc_feature (153)..(153): n is a, c, g, or t
  modified_base (241)..(241): a, c, t, g, unknown or other
  misc_feature (241)..(241): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctccagataccaccggagaaatgtgttnacgcagtctccagccaccctgtctttgtcctccaggggacagagccaccctctcctggcggggccagtcagagtatagtagctacttntagcctggtatcagctagaacctggctggcgcaggcctctcatctataatcgacctatacgcacgggcccacgtcggaccgtcccaagtacgtagggttccagtggccaggtgggtcgtggggcagtaacctcactctcgaaccatcgaagcaacgacgtacgggactccgtaggtaacgtttatttcgagttacgtagttaactttagttcgatacgtccaggtcctagtctacgtaccggttcctaaccggttacttaccgggttttaccggaccgtaacgggtaccctaagccgttacggaacgtacgttaacggaaaccgtaacggttacggtcggttaaccacggtaccctaaaccgtcgttacccttggttacccttaaccg

SEQ ID NO: 199795 - DNA, 852 bp, Homo sapiens
  misc_feature: GYAE6OF02FKRS7.34.22.B11.1.454.CMB.1.raw
  modified_base (284)..(284): a, c, t, g, unknown or other
  misc_feature (284)..(284): n is a, c, g, or t
  modified_base (351)..(351): a, c, t, g, unknown or other
  misc_feature (351)..(351): n is a, c, g, or t
tcagtacacgtgatcacgaccggtgctcgatttagacgacagctcagggggaggaactgctcagttaggacccagagggaaccatggaaaccccagcgcagcttctcttcctcctgctactctgtctcccagataccaccggagaaattgtgttgacgcagtctccagcccacccttgttctttgtcctccgaggggacagacgccaccctctcctcggcggggccagtcgagtagtagttagtagtcttacttcttacgtccgtggtactcagcaacgaaccnggcctcggccgcccaggcctccctcgacttactattaactcgtcctaagtacgcgaccgggtccccnggtccacgtcccagtacgtacggttacaggtggacgtaggttcggggtcgtacggggacctaacgtccgttactaccgtcctaaccgtaccctacttacccgaaccacggtaaccgtacgggtaaccggtacccgttaagggtaaaccgtttacgtttttcggaacgtaacgggtttacgtttaacgtttaaccgtttaccgttaacgtaaaccggttttaaggtttacccgggttaccttaccgtaacccgtaacgtttaacccgggggttaccgggtttacccggggttaacccgggtaaacccgggtaaacgggggtaaacccggttaaaagggttaaaccgggtaaaacgttaaacccggaaaccgggttaccgttagggttaccgggttaaccgtaccggaacccgttaaacccgttacggtttacccgtttaccgggttttaccttacccggttacccggttttacccccgttacccggacccgttttaacccgg

SEQ ID NO: 199796 - DNA, 839 bp, Homo sapiens
  misc_feature: GYAE6OF02GW3Z8.34.22.B11.1.454.CMB.1.raw
  modified_base (192)..(192): a, c, t, g, unknown or other
  misc_feature (192)..(192): n is a, c, g, or t
  modified_base (244)..(244): a, c, t, g, unknown or other
  misc_feature (244)..(244): n is a, c, g, or t
tcagtacacgtgatcacgaccggtgctcgatttagacgacagctcagggggaggaactgctcagttaggacccagagggaaccatggaaaccccagcgcagcttctcttcctcctgctactctgctccagactaccacggagaattgtgttgacgcagtctccagccacctgtctttgtctccgaggggacngacgcccaccctctccgtcggccggggaccagtcgaggtacgttagtttaanacgactattccttaacttacggccgttacggtaaccagtaccgaacgtaaaccgttgggaccctacggacccctaccgacgtacctcctactaattaacgtggtcacgtaattaaccgtacgacgggtacctaccgtaggtaccctaccttacccgaaacggtaccggtaacgggttttccgaacgggttcgggaccttaaggggttacccgggggtacgtttaaccggggaactaacgggtttaccctttacccggtacctttccctaacccggaaacctaacctttaacccgaaacccggacggtttaaccggtaccgggttaaacggacccgtttaaagggttaaaaccggttttcgttttacggaccgtttaagtttaacggtttaactttaccggttaggttaaccgttaaacgttacgggtttccgttaacgtacctaaccggttcgttaacgggtccgttaccggtaccgggtaaccgaacgggtaaccgttaaagggtactaaactaacgggtacgtacggttggtacgacggtacgaccttagacgtttcgacttccgtacctacggttaccctaccgtgtaaccg

SEQ ID NO: 199797 - DNA, 816 bp, Homo sapiens
  misc_feature: GYAE6OF02J2S1S.34.22.B11.1.454.CMB.1.raw
  modified_base (174)..(174): a, c, t, g, unknown or other
  misc_feature (174)..(174): n is a, c, g, or t
  modified_base (234)..(234): a, c, t, g, unknown or other
  misc_feature (234)..(234): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (775)..(775): a, c, t, g, unknown or other
  misc_feature (775)..(775): n is a, c, g, or t
tcagtacacgtgatcacgaccggtgctcgatttagacgacagctcagggggagaactgctcagttaggacccagagggaaccatcggaaaccccagcgcagcttctcttcctcctgctactctggcctcccagactacccaccggaagtaaacttgtgttacgacgcagttccnccagccctaccctgttctttcgtcctaccgaggggaccaggactccccacccttctccgngggaccgggtaccagtcgaagtacgttattacgtacnccttacttgttacgccgttggttacncaacggccaaacgtaaccgtcggccgtgggaccctcccgacggtccttccccgtatacttaccttaattacgtcaccgttaagacgccggaacgggtccctaaccggtcgggtcccgttccccgaaagtaccggttaaccggttcggtaacgtcgggtaccggtgggttccgggttccggggtaaggcccctttaaggtaaccctttaccggcctttcaaccccgtttcaaccgtacgtacggccctaggttaaccgtcggtaaccgtccgttaaagggtaagtttcttccgggtattaaggtttacggtttaactttgtaaggttcccgaagtccgtaccgtactaaccgttcgtacgttaccctacgttacccgtttacgtaccggttaccgggacttacggggacctaggtcccgtagtacgtaaccgtaaacccggttaggtaacgttcgggtaacccttggacccttaacccnccggtttaacgttttccgtaccccggttatttaaccccggg

SEQ ID NO: 199798 - DNA, 753 bp, Homo sapiens
  misc_feature: GYAE6OF02G9D0Y.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctggctccagataccaccggagaattgtgttgacgcagtctcagccaccctgtctttgtctccgaggggacaggagcccaccctctccgtggcggggccagtcagagttacttagtagcttacttcttagccttggtactcagtacaacgtaaaccgtggacctggccgcccaggtcctcccgtactacttcctaagttaactcgacccttaatacggaccgaacggggccctaacggtcggacccgttacccgaacggtaccggtaacgggtttacaagggttcgggaccgtaacgggttcggggtacggtcggggggactacgggtaaccgttccgtaaaccgttcctaaccgtacccgtaaagttccgaacgtaccgtaacgtacggtacgggtaaccgtccggttaaacggtaaacggtttacgttttacgggtacgttaacggtttaacggtttaagtttacgtttacggtacgttacgacgtaacgtacgtacgtacgtacgtaccgtccgtaaccgttacgttacgtttacgggaccgtacggacctaacggtcgtacgtacgacgtaactaacggtacgtcggtacgtgtacgtaccgtacctcgtacgttcggtaccttaccg

SEQ ID NO: 199799 - DNA, 740 bp, Homo sapiens
  misc_feature: GYAE6OF02H4PAF.34.22.B11.1.454.CMB.1.raw
  modified_base (202)..(202): a, c, t, g, unknown or other
  misc_feature (202)..(202): n is a, c, g, or t
  modified_base (315)..(315): a, c, t, g, unknown or other
  misc_feature (315)..(315): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaaccggataaatttgtgttgacgcagtctccagcccacctgttctttcgctccgagggacagacnccaccctcgtcctggccgggcctagtcagtagttattagtacgtcttactttcttacgcttaggtatacagaccaagaaccgtggccgtaggacccgtccgacgcctccgtanattctaatagcgactagtagacgacgggtccaacgtcggtacccaccagacgtgtacgagtggacgtaggtcgggtcgngggacacgtctacncgttccacactatccaggacctagacgtaggacctcgtaggtacgttagtttcgacgttagttagtttaatttacgttacggtcgtaacggaccgttaacgtacttaaaccgttaccgttaacggttaccccggttaacccgttaacccggtttaaccgttttaccgggttttacccgggaaaccggggtacccgggtaaaccgttaacgggtaaccggttaacgggtaaccgtaaacggtaacccgggtaaaacgttaccggttaaccgggttaaccggtacggtaccgtaaacccgtaacccgttagttccgtttaccggttacttaccg

SEQ ID NO: 199800 - DNA, 947 bp, Homo sapiens
  misc_feature: GYAE6OF02GZXHE.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctctgctactctggctcccagataccacggagaaattgtgttagacgcagtcctccagccaccctgttctttcgtctccgtaggggacagacgcccaccctctccgtacggccggggaccagtacgaggaacgttatttacggtacgtaccttaacgtttaccgttacgtcccttgggttacctcgtaaccggacgtaaaccggtaaacccgtcggtacccgttcgggacccggacccccggtaggtccctaccccgttaccgtacttaaccgttaaacgttaacgttccgtaccccgttaagtaccgggaccgtacgggggtacccctaacgggttccgggtcccccggtaccccgaacggttaccgttacgggtttaaccgacgggtcgggtacgtacgggttcgggggtaccggtagggggtacctacggtacccgtttacctaccgttacttacccgtaacctacgtacccgaggtacctaacgggtaaccggtcggttacggtaaccgtacggtttaacgtttacttttacgggaccgttaaggtttaacccgttagtttaacgggttaccttacggtaacgttcgtaaacggttctaacgttaccggttaccgttaaccgggttacccgttaaccgttaacccggtttacggttttaccggaacccggggttaacccgggtaaccgtaaccggttcggaccgggttaaggttaaaccccgtttaaaccgggtaaaccggtttaaaccggttacgggttacccgggttaacccggtacgttacccttaaacccgttacggtttacccggtttaccgttaccgtttaaccccg

SEQ ID NO: 199801 - DNA, 792 bp, Homo sapiens
  misc_feature: GYAE6OF02JI8YM.34.22.B11.1.454.CMB.1.raw
  modified_base (143)..(143): a, c, t, g, unknown or other
  misc_feature (143)..(143): n is a, c, g, or t
  modified_base (483)..(483): a, c, t, g, unknown or other
  misc_feature (483)..(483): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggcctccagataccacgganaaattgtgttgacgcagtctccagccaccctgtctttgctcgaggggacagagccaccctctccgtcggaccggggccagtccaggacgttattagtacgtcttacttcttacgccttggtactcgagcaaacgtaaccgtcggccgtacggccgtccccgaggtcctccctacataccttataactcgtactagtcggacgacgggccaggtcggacccgtcccaggaaccgttcggttacacggtcggaccgtagggttcgggtccggtacggggctaaaccggttaccttactaccgttcctacccgaactacgtcgaccgagaaccgggttaccgngggtaacgtacccgttaaagggtaaagttttcgtttacggacttaaggggtttacttttaacgtttagttcgaccgtacggaccgttaggccttaaacttcggtaacggttaccgttacccggtaacccgttaaccgttttaacgggtttccgaacccggggttaacggaaccgttaacgggactttaaccggggtaagtacccgtttaaaaaccggggtaacttaaggggttacggttaacccgggtaccgtaccggtacccggttaacccgttagtttaccggtttaccggtaccgtttaaccccgg

SEQ ID NO: 199802 - DNA, 976 bp, Homo sapiens
  misc_feature: GYAE6OF02G0M4P.34.22.B11.1.454.CMB.1.raw
tcagtacacgtgatcacgaccggtgctcgatttagacgacagctcagggggaggaactgctcagttaggacccagagggaaccatggaaaccccagcgcagcttctcttcctcctgctactctgtctccagataccacggagtaaattgtgttgacgcagtctccagccaccctgttctttgtctccgagggacagacgcccacctctccgtggcgggccagtcagagttattagagtcttacttcttacgccttggtatcgagcaacgtaaaccgtcggcctcgggccgcccgaggtcctccgtactattacctattaaactcgaccttagtacggaccgacgggtaccctaccggttcgggacccgttaccccgaaggtaaccggttacgggttaccgtagggttccgggacggtaacggggttcggggtaccggtttcgggggactaaccggtttacccttacccgttaccgttacccttaccgaacctaacgttaccgacggaccgtacgtaaccggtcgggtaccgacggtttaaggtaagttttacgtttcggacgttaaggtttaccgttttaaagttttacggtttacggttaccgtaacgggttaaccgtacgtaacccgtttaacgtttacgttaaacccggggtttacccgggtttaacccgggttaaacccggttttaacccggttttttaacccgggggtttacccgggggaaacccccgggggtttaaaccgggaaaacccggttaacggggtttacccgggttaaacgggggtaaccgttttaaaaccccgggtaaaaaaccccgggtttaaacgggttaaaacccgggtttaccggggggtttaaaccgggttaccccgtttaacccggggtttaaaccccccaaaacccgggttttttaccgtttttaaccccggggttttaaccccgggttttaacccttttttaacccccccggggg

SEQ ID NO: 199803 - DNA, 668 bp, Homo sapiens
  misc_feature: GYAE6OF02F62SW.34.22.B11.1.454.CMB.1.raw
  modified_base (144)..(144): a, c, t, g, unknown or other
  misc_feature (144)..(144): n is a, c, g, or t
  modified_base (265)..(265): a, c, t, g, unknown or other
  misc_feature (265)..(265): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccgganaaattgtgttgacgcagtctcagtccacctgtcttgtctccgaggggtacagagccctaccctctccgtggccggggtccaagtcgagagtattagtacgctacttcttagcctaggtacncagactaacgaaacctggacctggtccacccgaggcctccctacattactaagtactcgacttaagtacgcgacgggtccacgtcggtacctaccgaacgtacgtacggttcgaaggtcggacgtaggttcggtcggngggaccaggtaccttacgactcncaccgatcgacggactagacgtacggtacgtccgtaacgtaagttagtttacgacgttaagttacgttaattagtttgacgttacgactaacgactactacgttagtaccggtacctaccgttaacgttaccgtttacggaaccgtacggaaccgtaacggtacgtacggaacgtaacgtaaccgtaaacgtaacgttagtcggtacgtacgaccgtaacctacttacgttcttacttaccg

SEQ ID NO: 199804 - DNA, 653 bp, Homo sapiens
  misc_feature: GYAE6OF02JHZTN.34.22.B11.1.454.CMB.1.raw
  modified_base (403)..(403): a, c, t, g, unknown or other
  misc_feature (403)..(403): n is a, c, g, or t
  modified_base (418)..(418): a, c, t, g, unknown or other
  misc_feature (418)..(418): n is a, c, g, or t
  modified_base (507)..(507): a, c, t, g, unknown or other
  misc_feature (507)..(507): n is a, c, g, or t
tcagtacacgtgatcacgaccggtgctcgatttagacgacagctcagggggaggaactgctcagttaggacccagagggaaccatggaaaccccagcgcagcttctcttcctcctgctactctggctcccagataccaccggagaaattgtgttgacgcagtctccgagccaccctgtctttgtctccgaggggacagacgccaccctctcctggcgggccagtcagagtattagtgacttacttcgtagccttggtactcgacgcaagaaccgtggcctcggccgccgtagtcctcgtcacttctaatacgtcgctaagtcgacgtacggaccagttcgggacctacccgaagacgtacggtcaaggcgtgtacggtgggtacgtcgggataacgtcttacnccgtctaccaaccgngtacgaacgcgtaacggacgtacggtacgtacgtaggaagttagtttcgtacgttagttaggttactttagttacgcgtacgcgacgtntaccgtacgtcgtacgtacgtacccgttacgttaccgtttcgaaccggtacgggaaccgtacggtcgtacggacgtagtaacccgaaacggtcggtacggtacggtacgacgtaccgtacgttctacggttccgttcgttaacccg

SEQ ID NO: 199805 - DNA, 752 bp, Homo sapiens
  misc_feature: GYAE6OF02I4G34.34.22.B11.1.454.CMB.1.raw
  modified_base (196)..(196): a, c, t, g, unknown or other
  misc_feature (196)..(196): n is a, c, g, or t
tcagtacacgtgatcacgaccggtgctcgatttagacgacagctcagggggaggaactgctcagttaggacccaggagggaaccatggaaacccagcgcagcttctcttcctcctgctactctggctcccagataccaccggagaaattgtgttgacgcagtctccagccaccctgtctttgtctcgaggggaaangcccacctctcctgcgacgggccagtcagagttgttggcagcaacttacgcctggtaccagcaacgaaaccgtcggccaggcctccacggacgtcctacacttctatcgacctacgtactaccacgacgggcccacgtgtcctacttccgacgtccgtagttcacggtcgcgtacggtcggggtacgtcgggacgtaggtacggttactaccgttcctaccgaaccttaggtacccgtaacggtccgaacggtccgttacgggtacgtaaccgttacgtacggtaaacgttcgtttacgtacgttaccgtttaaccttttaaacggtttccggtttaggttacccgtaagtaccgttaacgttaagttaaaacggttacgggttaccgggtacccgggtttacgggttacccgggtttacccgggaaacggttaaaccggggtaaccggtaaacgggtaacgtaaacgtaccgaaaacggttacgttcgggtacggtaccgtacggaccctaacggttctacgttacgttccttacgtacgtttcccttaacccgg

SEQ ID NO: 199806 - DNA, 780 bp, Homo sapiens
  misc_feature: GYAE6OF02JXIRK.34.22.B11.1.454.CMB.1.raw
  modified_base (532)..(532): a, c, t, g, unknown or other
  misc_feature (532)..(532): n is a, c, g, or t
tcagtacacgtgatcacgaccggtgctcgatttagacgacagctcagggggaggaactgctcagttaggacccagagggaaccatcggaaacccagcgcagcttctcttcctcctgctactctggctccagataccacggagaattgtgtgacgcagtcctcagccacctgtctttgctcgagggacagcgtccacctctccgtcggcgggctacgtcagtagttacttagatcttacttctgtcctggtatcgagtacacgaaccgtgaccacgtccctacccgacgtacctcctactaattacgtggtcgacactaccgttaccgtaccgggacccgttcggactaccgtacccgaaggaccgttacggttaccgtaagggttcggacgttacggggtcgggtacgttaccggggaactacggttaacctcgtacttacctaccctaactaaccgtcccgtaaccgacggtaaccggttacggacttaccggttaaggtaacgtttacggtttaccgtagttaacggttntttaaacgttacgtagttacgaacgtttaggtttaccggttctaaaccgtacgtaccggttacgttacgggtaccgttcgggtaaccgtaaccgggaaaccgggttaacgggtaaacccaaaggttaacccgaaacgggttacgttacggtacggtaccgggacttacccgttaaacggtcctttccggttaccgttaagtttcccaaacccgtttccccggtttaacccaccggtttaccttaacgg

SEQ ID NO: 199807 - DNA, 483 bp, Homo sapiens
  misc_feature: GYAE6OF01DSW11.10.76.G10.1.454.CMB.1.raw
  modified_base (473)..(483): a, c, t, g, unknown or other
  misc_feature (473)..(483): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacctcagcctcctggccatcagtgggctccggtccgaggatgacgctgagtttattactgtgtagcatgggatgacagcctgagtgcttatgtcttcggaactgggaccaaggtcaccgtcctacgtcacgcccaaggcccaacccactgtccactctcgttcccaccctcctccactactatgctgagcggctggcaggcgcagtgnnnnnnnnnnn

SEQ ID NO: 199808 - DNA, 491 bp, Homo sapiens
  misc_feature: GYAE6OF01BSSFH.10.76.G10.1.454.CMB.1.raw
  modified_base (451)..(451): a, c, t, g, unknown or other
  misc_feature (451)..(451): n is a, c, g, or t
  modified_base (479)..(491): a, c, t, g, unknown or other
  misc_feature (479)..(491): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtcccctgaccgattctctgcctccaagtctggcacgtcagccttcctggacatccgtggccctccagtctgcggatgaggctgtttatttctgttcagcacgggatgccagccggaatggctaagttgggtattcggcggagggaccaagttcgaccgtcctaagtcagcccaaggctcgcccctggtcactctcgttccccacctcctctactactntgctgagcggctggcaaggcgcagtagnnnnnnnnnnnnn

SEQ ID NO: 199809 - DNA, 481 bp, Homo sapiens
  misc_feature: GYAE6OF01DLPOF.10.76.G10.1.454.CMB.1.raw
  modified_base (304)..(304): a, c, t, g, unknown or other
  misc_feature (304)..(304): n is a, c, g, or t
  modified_base (472)..(481): a, c, t, g, unknown or other
  misc_feature (472)..(481): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacaaacagcctgagtatttggctgttcggcggcgggaccaagttgaccgtcctacgtcagcccaaggctgcccctggtcactctcgttcccaccctcctccactactatgctgagcggctggcaaggcgcatagnnnnnnnnnn

SEQ ID NO: 199810 - DNA, 487 bp, Homo sapiens
  misc_feature: GYAE6OF01AJ9JJ.10.76.G10.1.454.CMB.1.raw
  modified_base (477)..(487): a, c, t, g, unknown or other
  misc_feature (477)..(487): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcggacaagttgacgtctacgtcagcccaaggctcgccccctcggtcactctcgttccccaccctcctcccactactatcgctgacgcgggctcggcaaggccgcatagnnnnnnnnnnn

SEQ ID NO: 199811 - DNA, 542 bp, Homo sapiens
  misc_feature: GYAE6OF01EH65J.10.76.G10.1.454.CMB.1.raw
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttctggacatccgtggcctcagtctgcggatgaggctgtttatttctgttcagcacgggatgccagccggaatggcaagttggggtattcgggcggagggacctaaggttcgaccgttccgtaagtcacgcccgaaggctcgcccctcggtcactctcgttcccaccctcctccacctactactcgcttggacgtccgggtctcgggaccgaaagggtcccgacgtaagttaacggcgtcagtcgactgacgtcgtcacnncngngcg

SEQ ID NO: 199812 - DNA, 493 bp, Homo sapiens
  misc_feature: GYAE6OF01ES7UI.10.76.G10.1.454.CMB.1.raw
  modified_base (295)..(295): a, c, t, g, unknown or other
  misc_feature (295)..(295): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (453)..(453): a, c, t, g, unknown or other
  misc_feature (453)..(453): n is a, c, g, or t
  modified_base (484)..(493): a, c, t, g, unknown or other
  misc_feature (484)..(493): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagccccccagactcctcattaatgataacaacaatcggccctcaggggtctctgaccgattctctgcctccaagtctgcacttctgcctccctgtcatatctggtnccagggtgaggatgaggctgattattactgccactactatgacaacacgcctgagttagtttggcttgttcggcgtcgggacctaagttcgaccgtctacgtcacgccaaggcncgccccgtcgtcnctctcctccctccctcctccactactactcnctcgcggcggcgtcgacgacggcgacagtgnnnnnnnnnn

SEQ ID NO: 199813 - DNA, 492 bp, Homo sapiens
  misc_feature: GYAE6OF01AVLF6.10.76.G10.1.454.CMB.1.raw
  modified_base (249)..(249): a, c, t, g, unknown or other
  misc_feature (249)..(249): n is a, c, g, or t
  modified_base (482)..(482): a, c, t, g, unknown or other
  misc_feature (482)..(482): n is a, c, g, or t
  modified_base (485)..(492): a, c, t, g, unknown or other
  misc_feature (485)..(492): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattcnctgcctccaagtctggcacttctgcctccctggtcatatctggtctccagggtgaggatgaggctgatttatactgccactcctatgacaacagcctgagtatttggcttggttcggcggcgggaccaaggttgaccgtctacgtcagcccaaggctgccccctggtcactctcgttccccgccctcctccacttactatgctgacgcgggctcgggctaagggcgcataggncgnnnnnnnn

SEQ ID NO: 199814 - DNA, 490 bp, Homo sapiens
  misc_feature: GYAE6OF01EMH5F.10.76.G10.1.454.CMB.1.raw
  modified_base (480)..(481): a, c, t, g, unknown or other
  misc_feature (480)..(481): n is a, c, g, or t
  modified_base (483)..(490): a, c, t, g, unknown or other
  misc_feature (483)..(490): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttcgaccgtcctacgtcagcccaaggctgccccctcggtcactctcgtcccaccctccctccactactatcgctgacggcggctgggcaaggcgcataggnngnnnnnnnn

SEQ ID NO: 199815 - DNA, 499 bp, Homo sapiens
  misc_feature: GYAE6OF01DHV5D.10.76.G10.1.454.CMB.1.raw
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
  modified_base (349)..(349): a, c, t, g, unknown or other
  misc_feature (349)..(349): n is a, c, g, or t
  modified_base (489)..(499): a, c, t, g, unknown or other
  misc_feature (489)..(499): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgcaggttccaggcacacgcccccagacctcctcattaatgaataaacaacaatccggccctcgaggggtctctgaccgattctctgcctccaagtctggcacttctgcctcctggtcatatctggtctccagggtnaggatgaggctgattattacngccactcctatgacaaacngcctgagttatttggcttggttcggcggcggaaccagttcgaccgtctacgtcacgccaagctcgccccctcggtcactctcgttcccgccctcctccactactatcgctgacggcggctggcaagggccgacagtacgnnnnnnnnnnn

SEQ ID NO: 199816 - DNA, 487 bp, Homo sapiens
  misc_feature: GYAE6OF01D1YW1.10.76.G10.1.454.CMB.1.raw
  modified_base (344)..(344): a, c, t, g, unknown or other
  misc_feature (344)..(344): n is a, c, g, or t
  modified_base (479)..(487): a, c, t, g, unknown or other
  misc_feature (479)..(487): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataaacaacaatcggccctcagggtctctgaccgattctctgcctccaagtctggcacttctgcctcctggtcatatctggtctccgagggtgaggatgaggctgattattactgccactcctatgacaacngcctgagttatttggcttggttcggcggcgggacctaagttcgaccgtcctacgcacgccgaaggctcgcccctcgtcactctcgtcccgccctcctccactactatcgctgacgcggctggcaaggcgcatagnnnnnnnnn

SEQ ID NO: 199817 - DNA, 491 bp, Homo sapiens
  misc_feature: GYAE6OF01C6IWG.10.76.G10.1.454.CMB.1.raw
  modified_base (275)..(275): a, c, t, g, unknown or other
  misc_feature (275)..(275): n is a, c, g, or t
  modified_base (348)..(348): a, c, t, g, unknown or other
  misc_feature (348)..(348): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (478)..(478): a, c, t, g, unknown or other
  misc_feature (478)..(478): n is a, c, g, or t
  modified_base (482)..(491): a, c, t, g, unknown or other
  misc_feature (482)..(491): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcgggggcaggttatgatgttcattggtaccgccaggttccaggcacagcccccagactcctcattaatgaataacaacaatcggccctcagggtctctgaccgattctctgcctccaagtctggcacttctnccctcctggtcatactcgtggtctccgagggtgaggatgaggctgatttatactcgcctactctatgacaacngcctgagttattggcttggtcggcggcggtacagttgacctccactcagccagctcgcccctgcnctctcgtccccgcctccnccactactactcgcttgacggccgggctcgggacgaacggcgtcagngtcnnnnnnnnnn

SEQ ID NO: 199818 - DNA, 525 bp, Homo sapiens
  misc_feature: GYAE6OF01A5Z9H.10.76.G10.1.454.CMB.1.raw
  modified_base (515)..(516): a, c, t, g, unknown or other
  misc_feature (515)..(516): n is a, c, g, or t
  modified_base (518)..(525): a, c, t, g, unknown or other
  misc_feature (518)..(525): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcgaggggtctctgaccgattctctgcctccaagtctggcacttctgcctccctggtcatatctggtctcgagggtgaggatgaggctgattattactgccactcctatgacaacacgcctagtagttagtttggcttgggttcgggcgggcgggaacctaaggttcggacccgttccgtaccgtcgacgacccaaggcctcgccccctcggtcacctctcgttccccgccctccctccctactactactcgctcgacgccgggctcggctaacgggcgcaatagnncnnnnnnnn

SEQ ID NO: 199819 - DNA, 497 bp, Homo sapiens
  misc_feature: GYAE6OF01DVUO8.10.76.G10.1.454.CMB.1.raw
  modified_base (482)..(497): a, c, t, g, unknown or other
  misc_feature (482)..(497): n is a, c, g, or t
tcagcatagtagtgcacgaccggtgctcgatttagtcactcatacagggtcctgggcccagtctgtactgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccacctggacatcaccgggctccgaggaccggggacgaggccgaattattactgtgctaacttggactccaacctgactggttgggctttcggcggaggactaaggttcgaccgtctacgtcagcccaaggcctcgccccctcggtctacctcttcgttccccacctccctccactactatgctgacgcgggctggcaaggccgcatagnnnnnnnnnnnnnnnn

SEQ ID NO: 199820 - DNA, 490 bp, Homo sapiens
  misc_feature: GYAE6OF01CN6DS.10.76.G10.1.454.CMB.1.raw
  modified_base (273)..(273): a, c, t, g, unknown or other
  misc_feature (273)..(273): n is a, c, g, or t
  modified_base (470)..(470): a, c, t, g, unknown or other
  misc_feature (470)..(470): n is a, c, g, or t
  modified_base (478)..(479): a, c, t, g, unknown or other
  misc_feature (478)..(479): n is a, c, g, or t
  modified_base (484)..(490): a, c, t, g, unknown or other
  misc_feature (484)..(490): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacagcccccagactcctcattaatgaataacaacaatcggccctcagggtctctgaccgattctctgcctccaagtctggcaattcngccctcctggtcatatctggtctccagggtgagatgagctgattatactgccactcctatgacaacagcctgagtatttggctgttcgcggcggacagttcgaccgtctacgtcagcccagctcgcccctcggtcactctcgttccccgcctcctccacctacctatcgcttcgacgcgggctcggactagggccgntataggcnnacgtnnnnnnn

SEQ ID NO: 199821 - DNA, 485 bp, Homo sapiens
  misc_feature: GYAE6OF01DDUC7.10.76.G10.1.454.CMB.1.raw
  modified_base (455)..(455): a, c, t, g, unknown or other
  misc_feature (455)..(455): n is a, c, g, or t
  modified_base (476)..(485): a, c, t, g, unknown or other
  misc_feature (476)..(485): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccgagggtgaggatgaggctgattattactgccactcctatgacaacagcctgagttattggcttggttcggcggcgggaccaggttgaccgtctacgtcacgcccaggcctcgccccctcggtcactctcgttcccgccctcctccactactatgctgngcggctggcaggcgcagtagnnnnnnnnnn

SEQ ID NO: 199822 - DNA, 536 bp, Homo sapiens
  misc_feature: GYAE6OF01BF7C6.10.76.G10.1.454.CMB.1.raw
  modified_base (525)..(536): a, c, t, g, unknown or other
  misc_feature (525)..(536): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacagcccccagactcctcattaatgaataacaacaatcggccctcagggtttctagtcgcttctctgcctccaagtctggcaacacgcctcctgacaatctctgggctccaggctgacgacgaggctgaatattactgcagctcatatgtagatggtgtcctcgtttacaagggtttttcggacgggtacgggacctaaggcttcggaaccgttcctaaagttcgacgcccgtaaaggcctacgcccccgttcgtcctaaccttccttaccgttccccaaccccgttcctccctaacctactaactcgctcgacgcgggtctggctaaggcgacatagnnnnnnnnnnnn

SEQ ID NO: 199823 - DNA, 199 bp, Homo sapiens
  misc_feature: GYAE6OF01DCXBQ.10.76.G10.1.454.CMB.1.raw
  modified_base (103)..(103): a, c, t, g, unknown or other
  misc_feature (103)..(103): n is a, c, g, or t
  modified_base (198)..(198): a, c, t, g, unknown or other
  misc_feature (198)..(198): n is a, c, g, or t
tcagcatagtagtgcacgaccggtgctcgatttagtcactcatacagggtcctgggcccagtctgtgctgactcagccaccctcagcgtctgggccccccggnagaggtctccatctctgttctggagtcacttccaacatcggaaataatgatgtgagctggtaccagcaggtcccaggaaccgccccaaactcctna

SEQ ID NO: 199824 - DNA, 593 bp, Homo sapiens
  misc_feature: GYAE6OF01CVPAS.10.76.G10.1.454.CMB.1.raw
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
  modified_base (590)..(590): a, c, t, g, unknown or other
  misc_feature (590)..(590): n is a, c, g, or t
  modified_base (592)..(593): a, c, t, g, unknown or other
  misc_feature (592)..(593): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacacgcccccagactcctcaattaatgaataacaaacaaatcggccctcgaggggtctctgaccgattctctgcctccaagtctggcacttctcgcctcctggtcatatctggtctcgagggtgagntgaggctgattatactcgaccactcctatagacaaacgngcctagtagttagtttggcttggttcgggcggaccgggactaaggttcgaccgttactacgtcaacggacccgaaggcctaccggcccccgtacggtacctaaccgttccgttccgtttacccccaccccttccctacccgtaacttaacccgtactcgtaccggttcggaacggcccggggtacttaccggggaccgtaaacgggccgacccgtaagttacggcagcgcncncnncngnn

SEQ ID NO: 199825 - DNA, 695 bp, Homo sapiens
  misc_feature: GYAE6OF01DU92V.10.76.G10.1.454.CMB.1.raw
  modified_base (682)..(682): a, c, t, g, unknown or other
  misc_feature (682)..(682): n is a, c, g, or t
  modified_base (687)..(689): a, c, t, g, unknown or other
  misc_feature (687)..(689): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
  modified_base (695)..(695): a, c, t, g, unknown or other
  misc_feature (695)..(695): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgaataaacaacaatcggccctcgagggtctcgtcgaccgtattctctcgccctaccaagtctggctacttctcgcctcctgtcatatcgtggtctcgagggtgaggatggaggtctagtatttacgttacgtcgccctacttctaatcgaaccaacgtacgtccttaggtagtttagtttcgggtcgtttgggttccggggccggggtaccgggtaacccgtaagggtttccggaaccccggtttcccgttaaccggttaccgaaccggaccccggtaaacgggtccccttacccggtcccccccggtttaccgggttacccttaacccgtttcccgttccggtttaccccccccaacccctttccccgttaacccctaaccgtttaaccttacgttcgtccgttacggaccgggtccgggtccggttcgggaaccgaacggggtccgtaaccgtaagttacggctacgngcgcnnncngngn

SEQ ID NO: 199826 - DNA, 625 bp, Homo sapiens
  misc_feature: GYAE6OF01CFREB.10.76.G10.1.454.CMB.1.raw
  modified_base (84)..(84): a, c, t, g, unknown or other
  misc_feature (84)..(84): n is a, c, g, or t
  modified_base (105)..(105): a, c, t, g, unknown or other
  misc_feature (105)..(105): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (589)..(589): a, c, t, g, unknown or other
  misc_feature (589)..(589): n is a, c, g, or t
  modified_base (605)..(605): a, c, t, g, unknown or other
  misc_feature (605)..(605): n is a, c, g, or t
  modified_base (614)..(614): a, c, t, g, unknown or other
  misc_feature (614)..(614): n is a, c, g, or t
tcagcatagtagtgcacgaccggtgctcgatttagtcactcatacagggtcctgggcccagtctgtgctgactcagccaccctnagcgtctcggggccccccggnagagggtctccatctcttgttctggagtcacttccaactatcggaaataatgatgtgagctggtaccagcaggtcccagggaaccggcccccaaactccgtnatctanaccaatgatgtcgccggccctcgacgggggtccctgaccgtnttctctcgcctccaagtctggcacgtcanccttcngacactccgtggcctcagtctggcgatggaggcttgtttatttctgttcaggtcacgggatcgcagaccggatcggcgtaagttgggtagttcgggacgggtacgggacctaaggtttcgaccgttaccgtaacggtccgaacgacccgaacggccgtccggtacccccgtcggtacctaaccttccgttaccgttcccctaccccgttccctacccctaaccgttaacctactcgtcgtacgggtacggtccgggtcgttacgggaccgaacgggccggacgtaacggtacggtacgnggtgacgtagcgtacncgtcgacgncgcggtcacgg

SEQ ID NO: 199827 - DNA, 659 bp, Homo sapiens
  misc_feature: GYAE6OF01EHBV2.10.76.G10.1.454.CMB.1.raw
  modified_base (336)..(336): a, c, t, g, unknown or other
  misc_feature (336)..(336): n is a, c, g, or t
  modified_base (648)..(649): a, c, t, g, unknown or other
  misc_feature (648)..(649): n is a, c, g, or t
  modified_base (653)..(653): a, c, t, g, unknown or other
  misc_feature (653)..(653): n is a, c, g, or t
  modified_base (655)..(659): a, c, t, g, unknown or other
  misc_feature (655)..(659): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcgggggcaggttatgatgttcattggtaccgccaggttccaggcacacgcccccagacctcctcattaatgaataaacaacaatccggccctcgagggtctcgtgaccgtattctctgccctccaagtctggctacttctcgcctcctggtcatctctggtctccgagggtgaggatgagctgtattatacncgcctactcctaatcgaaccaacagtcccttagacgtttagtttcggcgtttcggttcgggaccggggtaccggggtaacccgtaagggttaccggtacccggttacccgttaacccggtacgtaccgaccccgaaacgggtccctcccggtccccccgttaccgggttcctacccgtttcccgttcccggtttccccccgtcccccttaccccgttacccctaaccgttaccgttaacgttccgtccgttacgggaccgggtccgggtcgtaccgggtaccggaaaccgggtccgaccgtaggtacgcgtnncgcncnnnnn

SEQ ID NO: 199828 - DNA, 500 bp, Homo sapiens
  misc_feature: GYAE6OF01A6BPR.10.76.G10.1.454.CMB.1.raw
  modified_base (346)..(346): a, c, t, g, unknown or other
  misc_feature (346)..(346): n is a, c, g, or t
  modified_base (493)..(500): a, c, t, g, unknown or other
  misc_feature (493)..(500): n is a, c, g, or t
tcagcatagtagtgcacgaccggtgctcgatttagtcactcatacagggtcctgggcccagtctgtgctgactcagccaccctcagcgtctgggcccccagggcagagggtctccatctcctgcactgggagcagaaccagcatcggggcaggttatgatgttcattggtaccgccaggttccaggcacacgcccccagactcctcattaatgaataacaacaatcggccctcgaggggtctctgaccgattctctgcctccaagtctggcacttctgccctcctggtcatatctgtctccgagggtgaggatgaggctgtattattactgccactcatgaacacngcctgagttattggctgttcggcggcggacagtcgaccgtcctacgtcacgcccgaaggcctccgccccgtcgtccacctctccgttccccgcccttccctccctactacctactcgctgacggcgggctggacgacggcacatgcnnnnnnnn

SEQ ID NO: 199829 - DNA, 493 bp, Homo sapiens
  misc_feature: GYAE6OF01BXCT3.10.76.G10.1.454.CMB.1.raw
  modified_base (280)..(280): a, c, t, g, unknown or other
  misc_feature (280)..(280): n is a, c, g, or t
  modified_base (437)..(437): a, c, t, g, unknown or other
  misc_feature (437)..(437): n is a, c, g, or t
  modified_base (453)..(453): a, c, t, g, unknown or other
  misc_feature (453)..(453): n is a, c, g, or t
  modified_base (481)..(493): a, c, t, g, unknown or other
  misc_feature (481)..(493): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgcggccctcaggggtccctgaccgattctctgcctccaagtctggcacgtcagccttccnggacatccgtggcctccagtctgcggatgaggtcttgtttattctgttcagcacgggatgccaggccggatggctaagttgggtattcgggcggagggacctaggttcgaccgtctagtcacgccgaagcctcgcccctcggtcactctcgttcccnccctcctccactactntcgctgacgcggctggcaggcgcatagnnnnnnnnnnnnn

SEQ ID NO: 199830 - DNA, 520 bp, Homo sapiens
  misc_feature: GYAE6OF01BUR4A.10.76.G10.1.454.CMB.1.raw
  modified_base (507)..(520): a, c, t, g, unknown or other
  misc_feature (507)..(520): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataccaatgatgtgcggccctcgaggggtcccctgaccgattctctgcctccaagtctggcacgtcagccttcctggacatccgtggcctccagtctgcggatgaggcttgtttatttctgttcagcacgggatgccagccggaatgggactaagttggggtattcgggcggagggacctaaggttcgaccgtctaagtcacgcccgaaggcctcgccccctggtccactcgtcgtccccgccctccctccacctactactcgctgacggcgggtcgtcggacgaacggccgacagtagnnnnnnnnnnnnnn

SEQ ID NO: 199831 - DNA, 713 bp, Homo sapiens
  misc_feature: GYAE6OF01B6LH3.10.76.G10.1.454.CMB.1.raw
  modified_base (273)..(273): a, c, t, g, unknown or other
  misc_feature (273)..(273): n is a, c, g, or t
  modified_base (708)..(708): a, c, t, g, unknown or other
  misc_feature (708)..(708): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacacgcccccagactcctcattaatgataacaacaatcggccctgagggtctctgacgtattctctcgcctcaagtctggcacttcngtccctccgtggtcctatactcgtcggtcctccgagggttgaggaagtggaggtctgtaatttagttactcgacctacttcctagtacgtaaccaaacgacgtcctaggtacgtttacgtttggccgtttgggttaccgggaccggggtaccggggtaacctaaagggttccgtaacccgtttacccgtacggttaccgaaccggtaccccgtaagggtccccgttacccggtcccccggttaccgggttccctaacccgtttcccggttccggtttccccccgttccccttccccgtttaccccgtaacccgtttaaccgttaacgttcccgggtacgttacgggtaaccgggcccggggttaccgttacggggaccgtaaaccggggaccggttaccgaaaggtacgggtcctacgacgtacgtcgacgatcngtgcg

SEQ ID NO: 199832 - DNA, 497 bp, Homo sapiens
  misc_feature: GYAE6OF01C6JTI.10.76.G10.1.454.CMB.1.raw
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
  modified_base (428)..(428): a, c, t, g, unknown or other
  misc_feature (428)..(428): n is a, c, g, or t
  modified_base (488)..(497): a, c, t, g, unknown or other
  misc_feature (488)..(497): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcgggggcaggttatgatgttcattggtaccgccaggttccaggcacacgcccccagacctcctcattaatgaataacaacaatccggccctcgagggtctctgaccgtattctctcgcctccaagtctggctacttctcgcctccctggtcatatcgtgtctccgagggtgagntgaggctgattatactcgcctactctatcgacaacngcctgacgttattggcttggtcggcggacgggacctagtcgaccgtctacgtcacgccaggctcgcccctcgtcnctcgtctcccgccctcctccactactactcgctgcgcgggcgtcggcgacgcgcagtagnnnnnnnnnn

SEQ ID NO: 199833 - DNA, 717 bp, Homo sapiens
  misc_feature: GYAE6OF01C89M2.10.76.G10.1.454.CMB.1.raw
  modified_base (103)..(103): a, c, t, g, unknown or other
  misc_feature (103)..(103): n is a, c, g, or t
  modified_base (700)..(700): a, c, t, g, unknown or other
  misc_feature (700)..(700): n is a, c, g, or t
  modified_base (704)..(704): a, c, t, g, unknown or other
  misc_feature (704)..(704): n is a, c, g, or t
  modified_base (706)..(707): a, c, t, g, unknown or other
  misc_feature (706)..(707): n is a, c, g, or t
  modified_base (709)..(717): a, c, t, g, unknown or other
  misc_feature (709)..(717): n is a, c, g, or t
tcagcatagtagtgcacgaccggtgctcgatttagtcactcatacagggtcctgggcccagtctgtgctgactcagccaccctcagcgtctgggccccccggnagaggatctccatctcttgttctggagtcacttccaacatacggaaattaatgatgtgagctggtaccagcaggtcccagggaaccgccccaaatcctcatctataccaatgatggcgcgccctgacgggtccctgaccgtatcctcgtgcctaccaagtcgtcggccaacgtcacgtccttcgtcggacctagttcccggtcggtcccttaccgacgtttccgtagggaccggtagtcggtacggttcgtttttaggttttaacttttccgttcggtttacgacggtacgggtaaccggggtattccggaacccggacggtaccgggtaaagttcgggtaaccgttaagggtttacggggtttacgtaccgggggtacggggtaaccgggtaaccgttaagggttaccggtaacccggttacccgttaaacggtccgaaccggtaaccccgtaacgggtcccgtacccggtccccccgttcgggtcctaacccgttccgttacccgttaccccctaaccccgttacctaacgttacgtacgtcgtacctggacgggtccggtacgtacgggacgtaacggcccgtaagtaagtcgntcgnanncnnnnnnnnn

SEQ ID NO: 199834 - DNA, 842 bp, Homo sapiens
  misc_feature: GYAE6OF01CNSHG.10.76.G10.1.454.CMB.1.raw
  modified_base (102)..(102): a, c, t, g, unknown or other
  misc_feature (102)..(102): n is a, c, g, or t
tcagcatagtagtgcacgaccggtgctcgatttagtcactcatacagggtcctgggcccagtctgtgctgactcagccacctcagcgtctgggcccccgggnagagggtctccatctcttgttctggagtcacttccaacatcggaaataatgatgtgagctggtaccagcaggtcccaggaaccggcccccaaactcctcatctataccaatgatgtgccggccctcgacggggtccctgaccgtattcctctcgcctaccaaagtctggccacggttcacgtcctttccgtggacctacgtcccggtggccccttccgagttccgtggacggatggtacgtaactttgttttttaacttttccgttgtttaccgaacggtcgtaaccgggggtacgttcggacccgtaacgggacccgggtaaagtcggggtacctaaaaggttttcgggggggtaaccttttacggggggaccggggtaaacgggggtaaacccgttaaacgggttttccgggtaaccccggtttacccgttaaacggttaccggaaccggtaccccgtaaaccggggtcccgttaccccggtacccccccggtttaccggttaccccgtaaccccggtttacccggttaccccggtttcccccccggtacccccgtttacccccgttaccccgttaaaccccgtttaaccgtttaccggttaaccggcccggtttacggggtaccgggttacccggggggtaccgttaccggggaccggtaacccggggaccggttaacccgtaacggttaaccgggacgtcggtacacggctacgtacgtaactctacgagctgtgc

SEQ ID NO: 199835 - DNA, 692 bp, Homo sapiens
  misc_feature: GYAE6OF01EIJ75.10.76.G10.1.454.CMB.1.raw
  modified_base (340)..(340): a, c, t, g, unknown or other
  misc_feature (340)..(340): n is a, c, g, or t
  modified_base (682)..(683): a, c, t, g, unknown or other
  misc_feature (682)..(683): n is a, c, g, or t
  modified_base (685)..(685): a, c, t, g, unknown or other
  misc_feature (685)..(685): n is a, c, g, or t
  modified_base (687)..(692): a, c, t, g, unknown or other
  misc_feature (687)..(692): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggagcagaaccagcatcggggcaggttatgatgttcattggtaccgccaggttccaggcacacgcccccagacctcctcattaatgaataacaacaatccggccctcgacgggtctctcgaccgtattctctcgccctacagtctggctacttctcgccctccgtgtcatactcgtggtcctcgagggtgaggatgagtctagtatttattcncgcctacttctatcgaactacgacgtcctgtagtttagtttcggacgtttcgggttccgggaccggggtaccgggtaacccgtaacgggtttccggtaaccccggttcccgttaacggtacccgtaaccggtaccccggaaccgggtccccgttaccccggtcccccccggttccgggttacccgttaccccgtttcccgtttaccccggtttaccccccctaaccccctttcccccgttaaccctaaccccgtttaaccgttaccgttccgtccgttacgggtaccggggtccgggttccggtacgggaccggtaaccggggtcccgtactaaggagtcgnncncnnnnnn

SEQ ID NO: 199836 - DNA, 572 bp, Homo sapiens
  misc_feature: GYAE6OF01BTGYZ.10.76.G10.1.454.CMB.1.raw
  modified_base (375)..(375): a, c, t, g, unknown or other
  misc_feature (375)..(375): n is a, c, g, or t
  modified_base (561)..(572): a, c, t, g, unknown or other
  misc_feature (561)..(572): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcgggggcaggttatgatgttcattggtaccgccaggttccaggcacacgcccccagacctcctcattaatgaataaacaacaatcggcccctcgagggtctcgtgaccgattctctgcctaccaagtctggcactttctacctccctgtcatatctggtctccgagggtgaggatgagctgtattatttactcgcctacttcctatacgaactaacacgtcctagtagttntttcggctttcgggttccgggcgggtccgggaacgtaagttccgtaccgtccgtacgtaccgacgacccgaacggtcctccgcccccgttcggtcctaccgttccttccgttcccctacccgttccctaccctaccttactacttcgcttcggacggtcgggcgttcggaccgacggcgcagtagnnnnnnnnnnnn

SEQ ID NO: 199837 - DNA, 587 bp, Homo sapiens
  misc_feature: GYAE6OF01BXU2T.10.76.G10.1.454.CMB.1.raw
  modified_base (356)..(356): a, c, t, g, unknown or other
  misc_feature (356)..(356): n is a, c, g, or t
  modified_base (561)..(561): a, c, t, g, unknown or other
  misc_feature (561)..(561): n is a, c, g, or t
  modified_base (566)..(566): a, c, t, g, unknown or other
  misc_feature (566)..(566): n is a, c, g, or t
  modified_base (569)..(569): a, c, t, g, unknown or other
  misc_feature (569)..(569): n is a, c, g, or t
  modified_base (578)..(578): a, c, t, g, unknown or other
  misc_feature (578)..(578): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaatcctcatctataccaatgatgtgccggccctcgacggggtccctgacccgtattctctcgcctcctaagtctggccacggtcagtccttcctggaccagtccgtggccctccaggtctggcggtatgaggtcttgttttattcgtgttcacgcgacggntcgcgacgccggaagtcgggactaaggttggggtacgttccgggacgggtagggtacctaagggttcgtacccgtactaacgtcgacgcccgaaggccgtcgcccccgtcggtccaccgttcctccgttaccccacccttccctaccctacttctagtcgcgtcggacggccgggtcgtcgggacaacgggccacgtagtacggncgagngtncgatgactnacgcngngn

SEQ ID NO: 199838 - DNA, 544 bp, Homo sapiens
  misc_feature: GYAE6OF01AWD47.10.76.G10.1.454.CMB.1.raw
  modified_base (217)..(217): a, c, t, g, unknown or other
  misc_feature (217)..(217): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
  modified_base (535)..(544): a, c, t, g, unknown or other
  misc_feature (535)..(544): n is a, c, g, or t
tcagcatagtagtgcacgaccggtgctcgatttagtcactcatacagggtcctgggcccagtctgtactgacgcagcccgccctcagtatctggggccccagggcagagggtctccatctcctgcactgggagcagaaccagcagtcgggggcaggttatgatgttcattggtaccgccaggttccaggcacacgcccccagacctcctctattaangaataacaacaactccggccctcgacgggtctctggaccgtattcctctcgccctaccaagtctggctaccttcctcgtccctcccgtggtcagttactccgtggtcctccggagggtgaaggatggaggcttaggtatttattactcgaccctacctcctagtcgaacaactgtcctagtagttagtttcggcttggtccgggcggcggacctaggtcgaccgtctacgcacgaccaggcctcgcccgtacgtactcctcgtccccncctccctacactctatgntcgagccggntcgcgacggcgcgtacgtngcnnnnnnnnnn

SEQ ID NO: 199839 - DNA, 775 bp, Homo sapiens
  misc_feature: GYAE6OF01DUTCG.10.76.G10.1.454.CMB.1.raw
  modified_base (756)..(757): a, c, t, g, unknown or other
  misc_feature (756)..(757): n is a, c, g, or t
  modified_base (759)..(759): a, c, t, g, unknown or other
  misc_feature (759)..(759): n is a, c, g, or t
  modified_base (761)..(761): a, c, t, g, unknown or other
  misc_feature (761)..(761): n is a, c, g, or t
  modified_base (766)..(766): a, c, t, g, unknown or other
  misc_feature (766)..(766): n is a, c, g, or t
  modified_base (769)..(773): a, c, t, g, unknown or other
  misc_feature (769)..(773): n is a, c, g, or t
  modified_base (775)..(775): a, c, t, g, unknown or other
  misc_feature (775)..(775): n is a, c, g, or t
tcagcatagtagtgcacgaccggtgctcgatttagtcactcatacagggtcctgggcccagtctgtgctgactcagccaccctcagcgtctcgggccccccggcagaggtctccatctcttgttctggagtcacttccaacatacggaaataatgatgtgagctggtaccagcgacggtcccgaacggaaccgacccccaaactcctcactactactaaccaatgatgtcgccggccctcggaccggggtccctagaccgtattcctcgtcgccctacctaagtccgtcggacctacggtccacggtccctttcgacggacctacgttccggtcgcccctccgacgttcgtcggaccggtatagggtacgttcgttttagttttactttcgttcgttacgaacggtccgtaacggggtactaccggaccgtacgggtaccggtaaagtcgggtaacgttaagggtttggggtacggttaccgggggaacggggtaaccggtaaccggtaacggtttcccggtaaccgttacccggttaaacggccgaaccggtacccggtaacggtaccccgttaccccgtccccccggttacgtaccccgttaccctttacccgtttcccccgttaaccccccccttacccttacccccttacccgttaaacccttaccgttaccgtaccggtaccgtccgggtaacggggtcccggttccggtacggaacccggaccgggtaccgacgtaaaccggtgccggtnncncncgcgngcnnnnngn

SEQ ID NO: 199840 - DNA, 501 bp, Homo sapiens
  misc_feature: GYAE6OF01AO9XL.10.76.G10.1.454.CMB.1.raw
  modified_base (105)..(105): a, c, t, g, unknown or other
  misc_feature (105)..(105): n is a, c, g, or t
  modified_base (281)..(281): a, c, t, g, unknown or other
  misc_feature (281)..(281): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
  modified_base (486)..(486): a, c, t, g, unknown or other
  misc_feature (486)..(486): n is a, c, g, or t
  modified_base (488)..(501): a, c, t, g, unknown or other
  misc_feature (488)..(501): n is a, c, g, or t
tcagcatagtagtgcacgaccggtgctcgatttagtcactcatacagggtcctgggcccagtctgtgctgactcagccaccctcagcgtctgggcccccccgggnagagggtctccatctcttgttctggagtcacttccaacatcggaaataatgatgtgagctggtaccagcaggtcccaggaaccgacccccaaactcctcatctataccaatgatgtgcggccctgaggggtccctgaccgattctctgcctccaagtctggcacgtcagccttccnggacactccgtggcctccagtctgcgatgaggtctgttttattctgttcagtcacggggatgccaggccggaaatggactaagttggggatttcgggcggagggaccaagttcgaccgtctaagtcacgccaagcctcgcccctcggtcactctcgtcccncctccctccactactntcgctgagcgggcgtgcaggcgcatagntnnnnnnnnnnnnnn

SEQ ID NO: 199841 - DNA, 687 bp, Homo sapiens
  misc_feature: GYAE6OF01DFNB9.10.76.G10.1.454.CMB.1.raw
  modified_base (260)..(260): a, c, t, g, unknown or other
  misc_feature (260)..(260): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
  modified_base (673)..(673): a, c, t, g, unknown or other
  misc_feature (673)..(673): n is a, c, g, or t
  modified_base (676)..(677): a, c, t, g, unknown or other
  misc_feature (676)..(677): n is a, c, g, or t
  modified_base (679)..(687): a, c, t, g, unknown or other
  misc_feature (679)..(687): n is a, c, g, or t
tcagcatagtagtgcacgaccggtgctcgatttagtcactcatacagggtcctgggcccagtctgtactgacgcagcccaccctcagcgtctcgggacccccgggcaggagggtcaccatcttcttgtctggaagcagctaccaatggtcgggagagataatgtgtactggtaccagcacggtcccagggaacccggaccccaaactccacatactataacgattacgtcggccggccctcgacggggtcctggaccgtnttctcgtggcctcgagttcgtcggcctaccgtcacgccctccgtcggacctatcgagggtcgggtcccgtcccgggtacccggaggacgtcggaccgtcgtaggttatttattacgtggtagtacgactaggtacgggatagaccgtaggaccgttgacgttgtacttagtcggttaccgttacgggtaaccggtacgggaacgtaccggttacctacccgggttaccttaccggaccgaacccgaccccgaaacccggtacccccaaaccccgttcgtccgtaaccgtacccttacccgttcccgttacccccctacccgttcccctaactaacccttcgtaaccgttccgtaccgtacgggccgggtccgggtccggtacgaaccggtagggccctagtacggngancgangannannnnnnnnn

SEQ ID NO: 199842 - DNA, 838 bp, Homo sapiens
  misc_feature: GYAE6OF01A8UPS.10.76.G10.1.454.CMB.1.raw
  modified_base (104)..(104): a, c, t, g, unknown or other
  misc_feature (104)..(104): n is a, c, g, or t
  modified_base (810)..(810): a, c, t, g, unknown or other
  misc_feature (810)..(810): n is a, c, g, or t
  modified_base (831)..(831): a, c, t, g, unknown or other
  misc_feature (831)..(831): n is a, c, g, or t
tcagcatagtagtgcacgaccggtgctcgatttagtcactcatacagggtcctgggcccagtctgtgctgactcagccaccctcagcgtctgggccccccgggnagagggtctccatctcttgttctggagtcacttccaacatacggaaataatgatgtgagctggtaccagcaggtcccaggaaccggcccccaaactcctcatctataaccaatgatgtgccggtccctcgacgggtccctgaccgtattctctcgccctaccgaagtcgtcggctaccggtacacgtcctttccgtaggacctacgttccccggtcggtaccccttccgtagttccgtcgggtacggtagtggtacgggtcttttaggtttttacttttacgttcggttacgacgtccggtaacggggtactccggaccgtaaccgggacccggtaaggtttccggaacggtttaaggtttaccgggggttacggttaccggggggtacgggtaaaccggggtaaacccgttaaggggtttccccggtaacccggtttaaccggtaaacggtacccggtaacggtacccccgggtaaacgggtccccgttacccgggtacccccccggttacggtacccgttacccgtttcccgtttaccccggttcccccccggtacccccctttaccccgttacccccggtaaccgtttaccctaacggttcccggtacgttaccggggtaccgggtacccggggtcggttaacccggggaaccggtaaccgggtaccggtaccgaacggttaacggcggtacgtgaacgtccngacgtacctcgtacgtacgcngtctacg

SEQ ID NO: 199843 - DNA, 764 bp, Homo sapiens
  misc_feature: GYAE6OF01EC3KY.10.76.G10.1.454.CMB.1.raw
  modified_base (105)..(105): a, c, t, g, unknown or other
  misc_feature (105)..(105): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
  modified_base (744)..(744): a, c, t, g, unknown or other
  misc_feature (744)..(744): n is a, c, g, or t
  modified_base (748)..(749): a, c, t, g, unknown or other
  misc_feature (748)..(749): n is a, c, g, or t
  modified_base (751)..(751): a, c, t, g, unknown or other
  misc_feature (751)..(751): n is a, c, g, or t
  modified_base (755)..(755): a, c, t, g, unknown or other
  misc_feature (755)..(755): n is a, c, g, or t
  modified_base (757)..(758): a, c, t, g, unknown or other
  misc_feature (757)..(758): n is a, c, g, or t
  modified_base (760)..(760): a, c, t, g, unknown or other
  misc_feature (760)..(760): n is a, c, g, or t
  modified_base (762)..(762): a, c, t, g, unknown or other
  misc_feature (762)..(762): n is a, c, g, or t
  modified_base (764)..(764): a, c, t, g, unknown or other
  misc_feature (764)..(764): n is a, c, g, or t
tcagcatagtagtgcacgaccggtgctcgatttagtcactcatacagggtcctgggcccagtctgtgctgactcagccaccctcagcgtctcggggccccccggnaggagggtcctccatctcttgttctggagtcacttccaacatacggaaataatgatgtgagctaggtaccagcgacggtacccgaacgggaacccggaccccctaaactcctactactctaactaccaatgatgtcgcggtcctcgacgggtccngactctctcncgtcctcacgtctcggccacgtcacgtcctttccgagaccncgttccggtaccgcctccgnggtacgtcggacggtagtcggaggttctttgtttttactttcttcggttacgacgtaccggtaacggggtctcgtaccggacggtaccggtaacggtcggtaaccgtagggtttcggggtaccggggtacgggaaccgggggaacgggttaaaccgtaacgggtttacccgtaaccggttacccgttaacgggaccgtaaccggaccccgggtaaacggtccccgtaacccggttcccccgggttaccggttacccttaccccggttcccgtttcccccgggtttaccccccgtcccccgttaacccctttaccccgttaaccgttaaccgttaccggttaccggtccggtacgggttaccgggacggggtttcccgtacgggaggaccgggtccggacgttcgaatggaccngacnngncgcncnncngngn

SEQ ID NO: 199844 - DNA, 777 bp, Homo sapiens
  misc_feature: GYAE6OF01C44ZB.10.76.G10.1.454.CMB.1.raw
  modified_base (105)..(105): a, c, t, g, unknown or other
  misc_feature (105)..(105): n is a, c, g, or t
  modified_base (765)..(769): a, c, t, g, unknown or other
  misc_feature (765)..(769): n is a, c, g, or t
  modified_base (771)..(774): a, c, t, g, unknown or other
  misc_feature (771)..(774): n is a, c, g, or t
  modified_base (776)..(776): a, c, t, g, unknown or other
  misc_feature (776)..(776): n is a, c, g, or t
tcagcatagtagtgcacgaccggtgctcgatttagtcactcatacagggtcctgggcccagtctgtgctgactcagccaccctcagcgtctcgggccccccgggnagagggtctccatctcttgttctggagtcacttccaaacatacggaaataatgatgtgagctggaccagcaggtacccaagggaacccgacccccaaactcctacactctaactaacctaagtgagtcggtcgacccggtccctcgaccggggtcccctacgaccgtacttctcgtccgacctaccgagtcgtcggcctacgtccacgtccctttcgacggactaccgtccggtcggtcccctacgtacgttccgtggacggtagtacggtacggttcttttacgttttttactttcgttcgttacggaccggtaggtaaccggggtatccgggaccgtaaccgggaccggtaaggtacgggttacgttaacgggggtttcggggttacggttaccggggaaccgggggtaacgggttaaaccgtaacgggtttaccgtaacccggttaaccggttaaccgggtaccgacccggaacccggtaaccggtcccttccccggtaccccccgttccggtaacctccctttacccggttacccccttacccccgtaccccttaccccgttaaccctaacctttaaccgttacgttacggtaccggtacgggtaccgggtccgggcgttacgggacgtaaccgggccaacgtcgacgtcgagacnnnnntnnnngnc

SEQ ID NO: 199845 - DNA, 733 bp, Homo sapiens
  misc_feature: GYAE6OF01BTEA2.10.76.G10.1.454.CMB.1.raw
  modified_base (104)..(104): a, c, t, g, unknown or other
  misc_feature (104)..(104): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (709)..(709): a, c, t, g, unknown or other
  misc_feature (709)..(709): n is a, c, g, or t
  modified_base (715)..(715): a, c, t, g, unknown or other
  misc_feature (715)..(715): n is a, c, g, or t
  modified_base (721)..(722): a, c, t, g, unknown or other
  misc_feature (721)..(722): n is a, c, g, or t
  modified_base (724)..(724): a, c, t, g, unknown or other
  misc_feature (724)..(724): n is a, c, g, or t
  modified_base (726)..(728): a, c, t, g, unknown or other
  misc_feature (726)..(728): n is a, c, g, or t
  modified_base (730)..(730): a, c, t, g, unknown or other
  misc_feature (730)..(730): n is a, c, g, or t
  modified_base (732)..(733): a, c, t, g, unknown or other
  misc_feature (732)..(733): n is a, c, g, or t
tcagcatagtagtgcacgaccggtgctcgatttagtcactcatacagggtcctgggcccagtctgtgctgactcagccaccctcagcgtctgggccccccgggnagagggtctccatctcttgttctggagtcacttccaacatcggaaataatgatgtgagctggtaccagcacggtcccaaggaaccggacccccaaactcctcatctactaccaatgatgtcgccggtccctcggacggggtccctggaccgtatttcctcgtcgcctacctaagtccgtggaccaccgtcacgtccttcgngacncgtccgtcggcctccgagtctcggcggatggacggttctttagtttttactttcgttcgttaccgacggtaccggaacggggtactccggacccgtaacgggtaccgggtaaagtcgggaacgtttaaagggtttcggggtaacgtttccgggggaaccgggtaacggggtaaacccgtaagggtttccggtaacccggtttaaccgtaacggttccgaacccggtacccgaacgggtcccttcccggtacccccgttacggtcccttaacccgtttcccgtttaccccgtttacccccctacccctttccccgtacccgtaaccttaccgttacgtccggttccgtacgggtaccgggtccgggtccgtacgggaccgtaacgggccgacgtagtacgngcgtcntcgacnncncnnncngnn

SEQ ID NO: 199846 - DNA, 774 bp, Homo sapiens
  misc_feature: GYAE6OF01CV1RV.10.76.G10.1.454.CMB.1.raw
  modified_base (136)..(136): a, c, t, g, unknown or other
  misc_feature (136)..(136): n is a, c, g, or t
  modified_base (418)..(418): a, c, t, g, unknown or other
  misc_feature (418)..(418): n is a, c, g, or t
  modified_base (734)..(734): a, c, t, g, unknown or other
  misc_feature (734)..(734): n is a, c, g, or t
  modified_base (748)..(748): a, c, t, g, unknown or other
  misc_feature (748)..(748): n is a, c, g, or t
  modified_base (766)..(766): a, c, t, g, unknown or other
  misc_feature (766)..(766): n is a, c, g, or t
  modified_base (768)..(768): a, c, t, g, unknown or other
  misc_feature (768)..(768): n is a, c, g, or t
  modified_base (770)..(770): a, c, t, g, unknown or other
  misc_feature (770)..(770): n is a, c, g, or t
tcagcatagtagtgcacgaccggtgctcgatttagtcactcatacagggtcctgggcccagtctgtactgacgcacgcccgccctacagtatcgcgggccccgagggcaggaggtctcctatcctcctgaccacgnggggacgacaacgaaccgagacgaggtccggggtacgtagggttatgtagttcgttacgtaagtttccggaccgccggtacgtcccaggacaccgaccggccccagacctcctagtaattaagacaaactaacaaccgacgtcccggccgtaggaccgggttctacgacggtaccttacttccgtcgtaccgtacctagacgttcgcgtacctcgttttcaccgtccccgtttccgtaggtaccaatttcgtccgtccgttaccgcggttagggagtaaggngtaggacgtttcgtagtttaattaacccggtacccgttaacactaccggtataacgaacaccgtgtagttaagttggttcgtggacccgggttagggccgggtacgggtacggtaacgtaccggttaccgtaccgtaccgacgtaccgaaccggtaacccgtacggtcccgtcccgtaccgttcccggtacttaacccgttcccgttcccgtaacccctacccggttaccctaaccgttacccttacgtaccgttaccgagggttaacccggcgggtaccggtccgggtaacgggtaacccggacgggtaacccgnggtaacaaccgggngtcgagacgacgtagtancngngtac

SEQ ID NO: 199847 - DNA, 775 bp, Homo sapiens
  misc_feature: GYAE6OF01CFPSP.10.76.G10.1.454.CMB.1.raw
  modified_base (131)..(131): a, c, t, g, unknown or other
  misc_feature (131)..(131): n is a, c, g, or t
  modified_base (216)..(216): a, c, t, g, unknown or other
  misc_feature (216)..(216): n is a, c, g, or t
  modified_base (763)..(763): a, c, t, g, unknown or other
  misc_feature (763)..(763): n is a, c, g, or t
  modified_base (768)..(768): a, c, t, g, unknown or other
  misc_feature (768)..(768): n is a, c, g, or t
  modified_base (773)..(775): a, c, t, g, unknown or other
  misc_feature (773)..(775): n is a, c, g, or t
tcagcatagtagtgcacgaccggtgctcgatttagtcactcatacagggtcctgggcccagtctgtactgacgcagccgccctcagtatctgggccccagggcagagggtctccatctcctgcactgggancagaaccagcagtcgggcaggttatgatgttcattggtaccgcctaggttccaggcaccacgcccccagacctcctacaattaangactaacaactaacgtccggccctacgagggtcctctagaccgtattcctcgtcgtccctaccgtaagtcgtcggtacctacgttaccgtacggtccccttacccggttcggtacctaacgttaacgttccgttagggtacccttacccgggtaagggggttcggtaaacggggtacttaacgggtacgggtacgtttacggttaactttaaccgttttaaccgtccggtaacccttaaccgtttaccgtaacgttaaccggaaaactaaaccggtccgtaccggttaggtaacgttttaacggtttcggtaccgtttcgggttacccggggacggggtaacccgggtaaccgttaacggttccggtacccgttaccgttaacccgtacgaccggtacccggaaccggtaccgtaccggtacccccgttccggtaccgtaccgttaccgtttcccgttacccccgtcccttccctaccgtaacctacgtacgtcgtacgacggtcggtacggtcgaacgacggtaccgtacgagtagacgtcagacncgtancagcnnn

SEQ ID NO: 199848 - DNA, 810 bp, Homo sapiens
  misc_feature: GYAE6OF01APF0P.10.76.G10.1.454.CMB.1.raw
  modified_base (709)..(709): a, c, t, g, unknown or other
  misc_feature (709)..(709): n is a, c, g, or t
  modified_base (800)..(800): a, c, t, g, unknown or other
  misc_feature (800)..(800): n is a, c, g, or t
  modified_base (802)..(802): a, c, t, g, unknown or other
  misc_feature (802)..(802): n is a, c, g, or t
  modified_base (806)..(810): a, c, t, g, unknown or other
  misc_feature (806)..(810): n is a, c, g, or t
tcagcatagtagtgcacgaccggtgctcgatttagtcactcatacagggtcctgggcccagtctgtgctgactcagccacccctcagcgtcgtcgggcccccccgggcagagggtctccatctcttgttctggagtcacttaccaacatacggaaataatgatgtgacgcttggtaccagcacgggtacccaggaacccggaccccccaaactccctaccgtatctaactacctaatgtaactgtcgcccggtccctcggtacgggtccctacgacccgtattcctctcgccctaccgaagtccgtcggtccacgtccgaccgtccctttccgtacggacctaccgtccggtcccgggtacccctacccgtacgtcgttacggacgggttacggtacggtacgggttcgtttttacgttttaacgtttcccgtttagttaaccgaccggtaccggtaccgggggtactcccggaccgtacccgggacggttacggtcgtaacgttaacgggtttacgggttaccgttccggggacggggtaaccggtaacttaaccgggttaccggaacccgttacgtaacggtacccgaaccgttaccccggaacggtcccgtaccccgtcccccggtaccgtacccgtccgttccccgtttacccgtacccccccttacccgtacccccgttaccccaaccctttacccggttaacnccggggtcccggtaacccgggtacgggtccccgggtaggtacccggaccgggttaaccgccggactaaacgtccggatcgattccagtcananacannnnn

SEQ ID NO: 199849 - DNA, 791 bp, Homo sapiens
  misc_feature: GYAE6OF01ARNPJ.10.76.G10.1.454.CMB.1.raw
  modified_base (725)..(725): a, c, t, g, unknown or other
  misc_feature (725)..(725): n is a, c, g, or t
  modified_base (757)..(757): a, c, t, g, unknown or other
  misc_feature (757)..(757): n is a, c, g, or t
  modified_base (771)..(771): a, c, t, g, unknown or other
  misc_feature (771)..(771): n is a, c, g, or t
  modified_base (780)..(781): a, c, t, g, unknown or other
  misc_feature (780)..(781): n is a, c, g, or t
  modified_base (783)..(785): a, c, t, g, unknown or other
  misc_feature (783)..(785): n is a, c, g, or t
  modified_base (787)..(791): a, c, t, g, unknown or other
  misc_feature (787)..(791): n is a, c, g, or t
tcagcatagtagtgcacgaccggtgctcgatttagtcactcatacagggtcctgggcccagtctgtactgacgcagccgccctcagtatctgggccccagggcagaggtctccatctcctgcactgggagcagaaccagcagtcggggctaggtatgatgttcattcggtaccgccaggttccaggcacgaccgcccccgagtacctccgtacattaagtagtaataaaccaacaacgttcccggaccccttacggtaacgggggttcttccgtacggacccgtagtttcctcttccgaccctaccgtaacggttccgtccggtacgttacctttccgtccggtccccttaccccggttacgttacccttaacgtttaccggttcccgttcgggtttaccctacccggtacgggggttagggaaacgggttgtaccggggtaacggtcgtttacgttaacgttttaaccgtttaccgttacccggaaccccttaccgttaaccccgttataaccccggtaaaccgtaaaccgtacccggtacgttaacgggttaacggttttaacgttttccggggtaaccgtttcgggggttcccgggtaaccgggggtaccggggtaacccgtttaagggttacccgttacccggttacccggttacgtacccggtaccgtacccgaacggtcctccccggtcccgttccgtacctccgtcttcccgttcccnccctcccgtactacctctagcgtcagtccggngtccgtgcgtacgngcgacgtanncnnncnnnnn

SEQ ID NO: 199850 - DNA, 761 bp, Homo sapiens
  misc_feature: GYAE6OF01B4SQI.10.76.G10.1.454.CMB.1.raw
  modified_base (129)..(129): a, c, t, g, unknown or other
  misc_feature (129)..(129): n is a, c, g, or t
  modified_base (418)..(418): a, c, t, g, unknown or other
  misc_feature (418)..(418): n is a, c, g, or t
  modified_base (746)..(746): a, c, t, g, unknown or other
  misc_feature (746)..(746): n is a, c, g, or t
  modified_base (754)..(754): a, c, t, g, unknown or other
  misc_feature (754)..(754): n is a, c, g, or t
  modified_base (759)..(759): a, c, t, g, unknown or other
  misc_feature (759)..(759): n is a, c, g, or t
  modified_base (761)..(761): a, c, t, g, unknown or other
  misc_feature (761)..(761): n is a, c, g, or t
tcagcatagtagtgcacgaccggtgctcgatttagtcactcatacagggtcctgggcccagtctgtactgacgcagccgccctcagtatctgggccccaggcagagggtctccatctctgcactgggancagaaccagcagtcggggactaggttatgattgttctagttcggtaccgccgtacgggttccgaggccaaccgaccggaccccccaagacccttcctacctaatttaagtagaaacttaaaccaaaccgtaacgtcccgggtaccctacggtaacggggttcctaccgttacggtaccgtactttcctactcgccctacgtaacgtcgtacggacctaccgttcctcgtccccttccgtacgtctaatcgtcgttcggtccttccgggagggtcggacggtagtacggnggtacttagtattacgttacgtccgtacttaccgtaacgttacgtaaccgaactaaaccggtcgtaaccgttaggttacgggttttacgtttcggtaccgggtttccgggttacgggggcccggggtaccgggtaaccggttaacgggttacccggtacccgttaccggtaccgtacgtaccggtacccggtaaccggtcccgtccccggttccccgtaccggtacctaccgttcccgtttcccgtcccctacccttccctaccctaccttacgttaccgtcgtcgacggtccggcggtcgtacggacgacgacgtagtacgatgagntagcagtnacgtngn

SEQ ID NO: 199851 - DNA, 492 bp, Homo sapiens
  misc_feature: GYAE6OF02GSH29.10.76.G10.1.454.CMB.1.raw
  modified_base (481)..(492): a, c, t, g, unknown or other
  misc_feature (481)..(492): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggccctccagtctgcggatgaggctgtttatttctgttcagcacgggatgccagccggaatggcaattgggtattcgggcggagggaccaagttcgaccgtcctaagtcagcccaaggctcgccccctcggtcacttctcgttcccaccctcctccacctactatgctgagcgggctggcaaggcgcatagnnnnnnnnnnnn

SEQ ID NO: 199852 - DNA, 486 bp, Homo sapiens
  misc_feature: GYAE6OF02ITCT8.10.76.G10.1.454.CMB.1.raw
  modified_base (469)..(469): a, c, t, g, unknown or other
  misc_feature (469)..(469): n is a, c, g, or t
  modified_base (474)..(486): a, c, t, g, unknown or other
  misc_feature (474)..(486): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcagggggtcccctgacccgattctctgcctccaagtctggcacctcagcctccctggccatcagtgggctccggtcgaggatgacgctgattattactgtgtagcatggatgacagcctgagtgcttatgtcttcggactgggaccaaggtccaccgtcctacgtcacgcccaaggcccaaccccactgtcactcctcgttccccaccctcctccactactatgctgagcggctggcaggcncatgnnnnnnnnnnnnn

SEQ ID NO: 199853 - DNA, 480 bp, Homo sapiens
  misc_feature: GYAE6OF02GK3PR.10.76.G10.1.454.CMB.1.raw
  modified_base (344)..(344): a, c, t, g, unknown or other
  misc_feature (344)..(344): n is a, c, g, or t
  modified_base (471)..(480): a, c, t, g, unknown or other
  misc_feature (471)..(480): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacngcctgagtatttggctgttcggcggcgggaccagttgaccgtcctacgtcagcccaaggctgccccctcggtcactctcgttcccaccctcctccactactatgctgagcggctggcaggcgcatgnnnnnnnnnn

SEQ ID NO: 199854 - DNA, 487 bp, Homo sapiens
  misc_feature: GYAE6OF02HH4P9.10.76.G10.1.454.CMB.1.raw
  modified_base (478)..(487): a, c, t, g, unknown or other
  misc_feature (478)..(487): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaaacagcctgagttatttggcttggtttcggcggcgggaccaagttcgaccgtcctacgtcagcccaaggctcgcccctgtccactctcgttcccgccctcctccactactatgctgagcgggctggcaggcgcatgnnnnnnnnnn

SEQ ID NO: 199855 - DNA, 489 bp, Homo sapiens
  misc_feature: GYAE6OF02HWU7O.10.76.G10.1.454.CMB.1.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
  modified_base (449)..(449): a, c, t, g, unknown or other
  misc_feature (449)..(449): n is a, c, g, or t
  modified_base (480)..(489): a, c, t, g, unknown or other
  misc_feature (480)..(489): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcgggggcaggttatgatgttcattggtaccgccaggttccaggcacagcccccagactcctcattaatgataacaacaatcggccctcaggggtctctgaccgattctctgcctccaagtctggcacttcngcctccctggtcatatctggtctccgagggtgaggatgaggctgattattactgccactcctatgacaacngcctgagtatttggctgttcggcggcggacagttcgaccgtctacgtcacgcccaaggcctgccccctcggtccactctcgttcccaccctcctccactactntcgctgacgcgggctggacaggcgcatagcnnnnnnnnnn

SEQ ID NO: 199856 - DNA, 486 bp, Homo sapiens
  misc_feature: GYAE6OF02IR9ZM.10.76.G10.1.454.CMB.1.raw
  modified_base (354)..(354): a, c, t, g, unknown or other
  misc_feature (354)..(354): n is a, c, g, or t
  modified_base (471)..(486): a, c, t, g, unknown or other
  misc_feature (471)..(486): n is a, c, g, or t
tcagcatagtagtgcacgaccggtgctcgatttagtcactcatacagggtcctgggcccagtctgtgctgactcagccaccctcagcgtccgggtctcctggacagtcagtcaccatctcctgcactggaaccagcagtgactttgttgcttataactatgtctcctggtaccagcaccacccaggcaaacgcccccaaactccttgtttttgaggttcagtaagcggccctcaggagtccctgatcggttctctgcctccaagtctggcaacacggcctccctgaccgtctctgggctccaggctgaggatgaggctgattactactgcagcgcatacttcacggccccaagngggttgttggcggcgggactaaggtcgaccgtcgtgggtcagccagctcgccctggtcactctcgttcccacctcctccactactatcgctcgagccggctcggcaaggcgcagtgnnnnnnnnnnnnnnnn

SEQ ID NO: 199857 - DNA, 486 bp, Homo sapiens
  misc_feature: GYAE6OF02JADZN.10.76.G10.1.454.CMB.1.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
  modified_base (475)..(477): a, c, t, g, unknown or other
  misc_feature (475)..(477): n is a, c, g, or t
  modified_base (479)..(480): a, c, t, g, unknown or other
  misc_feature (479)..(480): n is a, c, g, or t
  modified_base (482)..(485): a, c, t, g, unknown or other
  misc_feature (482)..(485): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctcaagtctggcacttctgcctccctggtcatatctggtctccagggtnaggatgaggctgattattactgccactcctatcgacaacngcctgagttattggcttgtcggcggcgggaccaagttgaccgtctacgtcagcccaaggctcgcccctcgtcactctcgtcccaccctcctccactctactgctgacgcgggctcggcaaggcgcaatagnnncnntnnnnc

SEQ ID NO: 199858 - DNA, 486 bp, Homo sapiens
  misc_feature: GYAE6OF02HIAUM.10.76.G10.1.454.CMB.1.raw
  modified_base (343)..(343): a, c, t, g, unknown or other
  misc_feature (343)..(343): n is a, c, g, or t
  modified_base (419)..(419): a, c, t, g, unknown or other
  misc_feature (419)..(419): n is a, c, g, or t
  modified_base (476)..(486): a, c, t, g, unknown or other
  misc_feature (476)..(486): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctcctggtcatatctggtctccgagggtgaggatggaggctgattattactgccactcctatgacaanagcctgagttgtttgggtgttcgggcgacgggacaagctgaccgtcttagtcagcccaagctcgcccctcggtccnctctcgttcccaccctcctccactactactcgctgacgcgggctggcaggcgcatgnnnnnnnnnnn

SEQ ID NO: 199859 - DNA, 491 bp, Homo sapiens
  misc_feature: GYAE6OF02IS29Z.10.76.G10.1.454.CMB.1.raw
  modified_base (484)..(491): a, c, t, g, unknown or other
  misc_feature (484)..(491): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccgagggtgaggatgaggctgattatactgccactcctatcgaacaacagcctgagttatttggcttggtttcggcggcgggacctaaggttcgaccgtcctacgtcacgcccaaggcctcgcccctggtcactctcgtcccgcctcctccactactatgctgacgcggctggacgaggcgcatagnnnnnnnn

SEQ ID NO: 199860 - DNA, 478 bp, Homo sapiens
  misc_feature: GYAE6OF02FWCWU.10.76.G10.1.454.CMB.1.raw
  modified_base (445)..(445): a, c, t, g, unknown or other
  misc_feature (445)..(445): n is a, c, g, or t
  modified_base (465)..(465): a, c, t, g, unknown or other
  misc_feature (465)..(465): n is a, c, g, or t
  modified_base (469)..(478): a, c, t, g, unknown or other
  misc_feature (469)..(478): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatcgccagccggaatggcaagttgggtattcgggcggaggaccaagttcgaccgtctagtcacgccaagctcgcccctggcacttctcgttcccgcctcctccactactntcgctgagcggctggcagcnatgnnnnnnnnnn

SEQ ID NO: 199861 - DNA, 488 bp, Homo sapiens
  misc_feature: GYAE6OF02IOBXS.10.76.G10.1.454.CMB.1.raw
  modified_base (251)..(251): a, c, t, g, unknown or other
  misc_feature (251)..(251): n is a, c, g, or t
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (418)..(418): a, c, t, g, unknown or other
  misc_feature (418)..(418): n is a, c, g, or t
  modified_base (478)..(488): a, c, t, g, unknown or other
  misc_feature (478)..(488): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattcnctgcctccaagtctggcacttctgcctccctggtcatatctggtctccgagggtgaggntgagctgattattacngcctactcctancgaacaacagcctagattattggctgttcggcggcgggactagtgaccgtcctactcacgccaaggctccgcccctgtcnctctccgtcccgtcctccctctactactatcgtctgacgcggcgtgcgaaggcgcagtcnnnnnnnnnnn

SEQ ID NO: 199862 - DNA, 819 bp, Homo sapiens
  misc_feature: GYAE6OF02J1E2N.10.76.G10.1.454.CMB.1.raw
  modified_base (794)..(794): a, c, t, g, unknown or other
  misc_feature (794)..(794): n is a, c, g, or t
  modified_base (817)..(817): a, c, t, g, unknown or other
  misc_feature (817)..(817): n is a, c, g, or t
tcagcatagtagtgcacgaccggtgctcgatttagtcactcatacagggtcctgggcccagtctgtactgacgcagccgccctcagtatctggggcccagggccagagggtctccatctcctgcactggagcagaaccagcagtcgggcaggttactgatgttcattcggtaccgcctacggttccaggcacacgccccagacctccgtcattaatgaataacaacaatcggacccttgacggggttctcgtgaccgtattcctctacgtccctacctaacgtcgtacggcctacttctcgtcctacccgtggtactactactccttcggtcctcccgtaggggtcgtacgggtactagggtacgccgttaggtaactttacgttaactccggtaccctacgttacccgtttaagtcggtaaacctaacggtacggaccttaacggttaacggtttaacggttttccgggttaccggtttacggtttaccggggtccggggtaaccggggttaaacccgttaacgggttttaccggtaaccccggtttaacccggttaccgtaccggaaacccggttccccggaaaacgggttcccggtacccgtacccccgggtttaaccggtacccgttaaccccggttcctttaacccgggttccccctaaaccccgttttccccggttaaccccttaaccgtttaacccttacgttaccgtaccgggtacgtacccgggtaccggggtaccttaccgggtagttaccgggaccggtacgttaaccggctaacgcgttacncgttacaccgttagcgaccgttncg

SEQ ID NO: 199863 - DNA, 677 bp, Homo sapiens
  misc_feature: GYAE6OF02IYZRB.10.76.G10.1.454.CMB.1.raw
  modified_base (218)..(218): a, c, t, g, unknown or other
  misc_feature (218)..(218): n is a, c, g, or t
  modified_base (650)..(650): a, c, t, g, unknown or other
  misc_feature (650)..(650): n is a, c, g, or t
  modified_base (666)..(666): a, c, t, g, unknown or other
  misc_feature (666)..(666): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
  modified_base (674)..(676): a, c, t, g, unknown or other
  misc_feature (674)..(676): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggcccccaaactcctcatctataacgattancggcgccctcgaggggtcccctgaccgattcctcgtcggctccaagtctggccacctcacgccctccctggccatcaggtcgggcctccgggtcgaggactcggacgtctgtactttattacgtgtagtacgctagtgggactgacagtcctggtagtctacgttagtcgttaccgttacggaacgttcggggaaccgtaaggtcccgtaccccgttaccgtaccggttccaaccggtaccccgaaaccgggtacccctaaacccccgtacgttaccggttaccctaacctttccggtttacccgtttacccccgtacccccttaccccgttacccctaaccttaacccgttaacgttccggtaccggttacgggtaaccgggtcccgggtaccgttacgggacccggaaacgggtccgtaccgagttacgngctagctcgcgcgacncgcncncnnnc

SEQ ID NO: 199864 - DNA, 616 bp, Homo sapiens
  misc_feature: GYAE6OF02IMA62.10.76.G10.1.454.CMB.1.raw
  modified_base (212)..(212): a, c, t, g, unknown or other
  misc_feature (212)..(212): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(615): a, c, t, g, unknown or other
  misc_feature (613)..(615): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaangataaacaacaatccggccctcgaggggtctctgaccgattctctgccttccaagtctggctacttctcgcctcctggtcatatctggtctccgaggtgaggatgaggcttgattattactcgcctactcctatcgacaaacacgtcctgtacgttattttgggctttggtttccgggcgggaccgggtacctaaaggttcgacccggttcccttaacggtccaacgtacccgaacggtccgttccggcccccgttcggtacctaccttcccgttccgttacccctccccttcccttacccgtaccttaacgttacgttacgtccgttacggacggccggggtacgttcgggaccgtaacgggccggaccgtaacgtaacggtcgacgcgtctagcncncnnnc

SEQ ID NO: 199865 - DNA, 657 bp, Homo sapiens
  misc_feature: GYAE6OF02HQ9TD.10.76.G10.1.454.CMB.1.raw
  modified_base (635)..(635): a, c, t, g, unknown or other
  misc_feature (635)..(635): n is a, c, g, or t
  modified_base (641)..(641): a, c, t, g, unknown or other
  misc_feature (641)..(641): n is a, c, g, or t
  modified_base (646)..(646): a, c, t, g, unknown or other
  misc_feature (646)..(646): n is a, c, g, or t
  modified_base (649)..(649): a, c, t, g, unknown or other
  misc_feature (649)..(649): n is a, c, g, or t
  modified_base (655)..(655): a, c, t, g, unknown or other
  misc_feature (655)..(655): n is a, c, g, or t
  modified_base (657)..(657): a, c, t, g, unknown or other
  misc_feature (657)..(657): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaaccggccccaaatcctcatctataccaatgatgtgcgcctcagggtccctgaccgattctctcgcctccaagtctggcacgtcagtccttcctggacatccgtggccctccagtctgcggtatggaggtcttgttttactttcgttcgttcagcgtaacggggtatcgaccgtaggccggtaatcgggactaaaggtttcggggttaagtttcgggacggggtacgggaaccgtaaggtttcggaccgttaccgtaaggttaccgacggacccgtaagggccgttaccggcccccgttaccgggtacctaccgttccgtttccggtttcccccgtacccccgttccctaccccgtaacccgtttacccttaagtaccggttcgtacggtacgggtacccgggtcgttaccgggacggtaaccgggaccgtcgtaacgttcgacgcgtcgcncgtcgngcatnacncgtcgntn

SEQ ID NO: 199866 - DNA, 525 bp, Homo sapiens
  misc_feature: GYAE6OF02GRIE7.10.76.G10.1.454.CMB.1.raw
  modified_base (352)..(352): a, c, t, g, unknown or other
  misc_feature (352)..(352): n is a, c, g, or t
  modified_base (506)..(509): a, c, t, g, unknown or other
  misc_feature (506)..(509): n is a, c, g, or t
  modified_base (511)..(525): a, c, t, g, unknown or other
  misc_feature (511)..(525): n is a, c, g, or t
tcagcatagtagtgcacgaccggtgctcgatttagtcactcatacagggtcctgggcccagtctgtactgacgcagcctccctccgcgtccgggtctcctggacagtcagtcaccatctcctgcactggaaccagcagtgactttgttgcttataactatgtctcctggtaccagcaccaccaggcaaagcccccaaactccttgttttgaggtcagtaagcggccctcaggatccctgatcggttctcgtcgcctccaagtctggcaacacggcctcctgacccgtctctgggctccaggctgaggatggaggctgattactactgcagcgcatatcgacggaccccaagnggggttgttcgggcggtcgggaacgtaagggtcgaccgtcgtgggtcacgacccgaaggccgtcgccccgtcggtcctacctccgttccgtccccgtcccttccctccacttactactcgcgtgcggcggcgtcggacgacggcgcgtagtagnnnntnnnnnnnnnnnnnnn

SEQ ID NO: 199867 - DNA, 697 bp, Homo sapiens
  misc_feature: GYAE6OF02J3BFJ.10.76.G10.1.454.CMB.1.raw
  modified_base (231)..(231): a, c, t, g, unknown or other
  misc_feature (231)..(231): n is a, c, g, or t
  modified_base (300)..(300): a, c, t, g, unknown or other
  misc_feature (300)..(300): n is a, c, g, or t
  modified_base (691)..(691): a, c, t, g, unknown or other
  misc_feature (691)..(691): n is a, c, g, or t
  modified_base (695)..(696): a, c, t, g, unknown or other
  misc_feature (695)..(696): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggtatgatgttcattggtaccgccaggttccaggcacacgccccagactcctcattaatgataacaacaactcggccctnaggggtctctgaccgtattctctggtcttacaaggtctggactacgtatcgacacgtcccagtttcccnggccagtcaagtcgggacctccgaggtctaggaaagacgttcggaaggtcttaggtaactttaccgtaacgtcgtacccgtagtaccgttaagtacggaccaaaccgtaagtaccgttaacggttaaacgttttcggggtttaccgtttacggggacgggtaacggggtaccgacgggtaccgtaccgggtacccggttacccggttaaccgtaccgaaccggtaccccgtaaacggtcccgttacccggtccccccgttcggggttaccctaccgtttaccgtttcccgttaccccctaccccgtttacccctcccgtaaccttaacgttacgtcgtacgttcgacggtcggacgttcgggaccaacggcgtaccgtagtagcgcgctcnctcnnc

SEQ ID NO: 199868 - DNA, 531 bp, Homo sapiens
  misc_feature: GYAE6OF02I1S9D.10.76.G10.1.454.CMB.1.raw
  modified_base (297)..(297): a, c, t, g, unknown or other
  misc_feature (297)..(297): n is a, c, g, or t
  modified_base (342)..(342): a, c, t, g, unknown or other
  misc_feature (342)..(342): n is a, c, g, or t
  modified_base (471)..(471): a, c, t, g, unknown or other
  misc_feature (471)..(471): n is a, c, g, or t
  modified_base (519)..(519): a, c, t, g, unknown or other
  misc_feature (519)..(519): n is a, c, g, or t
  modified_base (525)..(531): a, c, t, g, unknown or other
  misc_feature (525)..(531): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggcctcagggtctctgaccgattctctgcctccaagtctggcacttctgcctcctggtcatatctgtctccgnggtgaggatgaggctgtattatactgcctactcctatgaacaacngcctgtagttatttggcttggttccgggcggtacggaccgtagttcggaccgtccctacgtcacggacccaaggctaccgccccgtcgtccaccttcgtccttaccccacccttccctaccacctactntcgactgacggcgggctagggccgtaacgggcgacctaagtacgtacngactgnnnnnnn

SEQ ID NO: 199869 - DNA, 691 bp, Homo sapiens
  misc_feature: GYAE6OF02HE6YM.10.76.G10.1.454.CMB.1.raw
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (689)..(689): a, c, t, g, unknown or other
  misc_feature (689)..(689): n is a, c, g, or t
  modified_base (691)..(691): a, c, t, g, unknown or other
  misc_feature (691)..(691): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcgaggggtctctgaccgattcctctcgcctccaagtctggctacttctcgcctccctggtcatactctggtctccgagggtgaggatggagctgtattattacgtcgacctacttacctatacgaacaaacgtcgtccttaggtaacgtttagtttcgggacgtttcgggtttccgggccggggtaccgggaacccgttaagggttaccgggtaaccccggttacccgttaccggtccgaaccggtaccccggaaacgggtcccgttcccggtccccccgttcgggttaccctacccgttccgtttacccgtttccccccgtaccccttccccttaccccgtaacctttaaccgttaccgttcgtaccgtttcgggaaccggtccgggggtaccgtccggggtacgtaaccggggacccgtaacggtaacgttacggcgtacgtacggctgngnctcngn

SEQ ID NO: 199870 - DNA, 651 bp, Homo sapiens
  misc_feature: GYAE6OF02JHGKF.10.76.G10.1.454.CMB.1.raw
  modified_base (635)..(635): a, c, t, g, unknown or other
  misc_feature (635)..(635): n is a, c, g, or t
  modified_base (639)..(639): a, c, t, g, unknown or other
  misc_feature (639)..(639): n is a, c, g, or t
  modified_base (650)..(651): a, c, t, g, unknown or other
  misc_feature (650)..(651): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagacctcctcattaatgaataacaacaactccgccctcgagggtcctctacgaccgtacttcctcttcgcccttccaaagtcctgggcctactttctcgtcccttcccgtggtaccatacgttcttggtccttccgagggtgacggatggaacggcgtgtaatttacttaactcgtacccgtaccttaccttactagtaaacccaacgtacggtacccttagggtaacgttttaagttttcgggaccgtttgggttttacccggggcgggggtacccgggtaacccggttaaggtttacccggtaacccggttcccgttaacggtccgaacgtacccggtaacggccgttccgcccccgttccggtccacttccgtccgttccctacctccctcccacttaccgtatcgtctgcgcgcgacgcgaggcctagacgacnagcngctagcagtcnn

SEQ ID NO: 199871 - DNA, 586 bp, Homo sapiens
  misc_feature: GYAE6OF02F6Z7U.10.76.G10.1.454.CMB.1.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (581)..(586): a, c, t, g, unknown or other
  misc_feature (581)..(586): n is a, c, g, or t
tcagcatagtagtgcacgaccggtgctcgatttagtcactcatacagggtcctgggcccagtctgtgctgactcagccaccctcagcgtctcgggccccccgggcagagggtctccatctcttgttctggagtcacttccaacatcggaaataatgatgtgagctggtaccagcaggtcccaggaaccggccccccaaatcctcatctacaccaatgatgtgccgccctgacggggtccctgaccgtattccncctcgcctccaacgtcgtcggcacgtcagccttccgtgacntccgtcgccctacngtctggcgatgagtcttgtttatttcgtnttcgagcgtacggntcnccgagcggaatgactaaggttcggtactacgggcggtaacgggtacctaaggttcgacccgttaccgtaacgtaccgtacggacccgtaagggaccctccggtcccccgttcgaacctccgttcccttcccgttacccctacccgttccctactacctactacgtcgccgtcggacggtcgggcgttacggaccgaacggcgcctagtgtcgnngnacnctnacngnnnnnn

SEQ ID NO: 199872 - DNA, 620 bp, Homo sapiens
  misc_feature: GYAE6OF02GBM8V.10.76.G10.1.454.CMB.1.raw
  modified_base (605)..(605): a, c, t, g, unknown or other
  misc_feature (605)..(605): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(619): a, c, t, g, unknown or other
  misc_feature (615)..(619): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagattcctcattaatgataacaacaatcggccctcgagggtctctgaccgattctctgcctccaagtctggacacttctgcctccctgtcatatctggtctccgagggtgaggatgaggtctagtattattactcgtacctactcctagtagaacaacagtcctagaagtttacgttttcggacgttgggtttccggggccgggaccggggtaaccgtaaacggtttcggacccggtttacccgtacgtaccgaacggtaccccgaacgggtcctcccggccccccgttcggtaccctaccgttaccttcccggtttcccccgtcccctcccttacccgtaaccttacctatccgtcgtacgacgggccgggtcgtcgggaccgtaacggccggaccgtaacgtagtcngacgtncncnnnnnc

SEQ ID NO: 199873 - DNA, 707 bp, Homo sapiens
  misc_feature: GYAE6OF02J0NEV.10.76.G10.1.454.CMB.1.raw
  modified_base (217)..(217): a, c, t, g, unknown or other
  misc_feature (217)..(217): n is a, c, g, or t
  modified_base (321)..(321): a, c, t, g, unknown or other
  misc_feature (321)..(321): n is a, c, g, or t
  modified_base (368)..(368): a, c, t, g, unknown or other
  misc_feature (368)..(368): n is a, c, g, or t
  modified_base (665)..(665): a, c, t, g, unknown or other
  misc_feature (665)..(665): n is a, c, g, or t
tcagcatagtagtgcacgaccggtgctcgatttagtcactcatacagggtcctgggcccagtctgtactgacgcagccgccctcagtatctggggccccagggcaggaggtctccatctcctgcactgggagcagaaccagcagtcgggctaggttatgattgttcattcggtaccgcctaggttccaggcacaccgccccagactcctacattaangaactaacaacacgtcggcctgacgggtctcgtgaccgtattctctcgcccttacgaagttcctggtacctacgtttcgtccgcccttcccggtagttaccatnttccgtcggtctacggtagggtcaggtatggacgtctagtacttacnctgcagctatattacgtccgaaccggccctaagggtaggtttggttaccgggcgggtacggtaacgtacggttccggtacccggtcggttacgggtaccgtaaccggccgaacgggttcctaccccgggtaccccgttacgggtaacccttaccggtttacccgttaccccgttaccccctacccgtttaccctaccccgttaacgtttacccgttagtcccggttaccgtacgggtaccgggttccgggtaccgggttacggaccggttaaccggttaccggacctaagtaccggntacgactacgacgacgtacgacgtacgtctacgtcgtcgtcg

SEQ ID NO: 199874 - DNA, 509 bp, Homo sapiens
  misc_feature: GYAE6OF02F62Z4.10.76.G10.1.454.CMB.1.raw
  modified_base (490)..(490): a, c, t, g, unknown or other
  misc_feature (490)..(490): n is a, c, g, or t
  modified_base (495)..(509): a, c, t, g, unknown or other
  misc_feature (495)..(509): n is a, c, g, or t
tcagcatagtagtgcacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcgaggggtccctgaccgattcctctcgcctccaagtctggcacgtcagccttcctggacagtcccgtggccctccagtctggcggatgaggcttgttttatttctgttcagcgacgggatgccaggccggaatggactaagttgggtatcggcgggaggaccaagttcgaccgtctaagtcagcccaaggctcgcccctcggtcacttctcgttcccgccctcctcctactactatcgctgacggcggcgtggacaggccganatagnnnnnnnnnnnnnnn

SEQ ID NO: 199875 - DNA, 531 bp, Homo sapiens
  misc_feature: GYAE6OF02IMW4Y.10.76.G10.1.454.CMB.1.raw
  modified_base (279)..(279): a, c, t, g, unknown or other
  misc_feature (279)..(279): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (483)..(483): a, c, t, g, unknown or other
  misc_feature (483)..(483): n is a, c, g, or t
  modified_base (497)..(497): a, c, t, g, unknown or other
  misc_feature (497)..(497): n is a, c, g, or t
  modified_base (525)..(531): a, c, t, g, unknown or other
  misc_feature (525)..(531): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagacctcctcattaatgaataacaacaatccggccctcaggggtctctagaccgtattctctgcctccaagtctggcacttcngcctcctgtcatatctggtctccgaggtgaggntgagcttgattattacngccnctctatgacaacacgtcctagtagttatttggcttcggtttcggcgggccggaacgtaggttcgacccgtccttaccgtcgacgcccgaaggcctccgcccccgttcgtccacttcgttccgtacccctccctccctcctacctactacngcctagacggcggngtggaccgtaggccgctactaggctgcnnnnnnn

SEQ ID NO: 199876 - DNA, 820 bp, Homo sapiens
  misc_feature: GYAE6OF02IA1UV.10.76.G10.1.454.CMB.1.raw
  modified_base (802)..(802): a, c, t, g, unknown or other
  misc_feature (802)..(802): n is a, c, g, or t
  modified_base (819)..(819): a, c, t, g, unknown or other
  misc_feature (819)..(819): n is a, c, g, or t
tcagcatagtagtgcacgaccggtgctcgatttagtcactcatacagggtcctgggcccagtctgtactgacgcagccgccctcagtatctcggggccccagggcaggagggtctccatctcctgcactgggagcagaaccagacagtcggggcaggttatgatgttcattggtaccgccaggttccaggcacacgccccagactcctctattaatagaataaacaaactaactccggcctacgacggggtctaccgtcgaccgtatttctactcgcctacgaaacgtcgtggctactttctacgtcccttccgtggtacattacttcgttcggtctaccggtagggtgaggtaactggaaggtcttagtaattactcgtacgacctactaccgtatacgaactaaacgtacgaccgttggtaacgtttagttttacgggccgtttacgggttcgggggacccgggtacggggtaaacccgtaaacgggtttaccgggttaaccccggttaacccgtttaaaccgggttaccgaaacccgggtaaccccggtaaacgggttcccggttaccccgggttacccccccggtttccggggttaacccgtaacccgttttcccgttccccggtttaccccccggtttacccccgtttacccccgtttaacccccgttaaaccgtttaaaccccgtttaaccggtccgggtttaccgttaccggggaaccgggttacccggggtaccggttaccggggtacccgaaacgggggtccgtaaacccgggtaaagtacggacctaaggtnacgtgacacgagacgtnc

SEQ ID NO: 199877 - DNA, 747 bp, Homo sapiens
  misc_feature: GYAE6OF02HQYDU.10.76.G10.1.454.CMB.1.raw
  modified_base (305)..(305): a, c, t, g, unknown or other
  misc_feature (305)..(305): n is a, c, g, or t
  modified_base (745)..(745): a, c, t, g, unknown or other
  misc_feature (745)..(745): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagtacctcctactattaatagaactaaacaaacaacttccggaccctacgtaaggggtccttcgtacgaccgtattcctcgtcgtcctaccaagtcgtggctacttcncgtccctcccgtggtctaatacgtcttcggtcctaccggaggtgacggtatacgggaggtcgttagtatttaacttacgtcgacctacttacctaagtacgaactaaacgtacgtcgttaggtagtttagtttacggtcgttagggtccggggtacggaccgggtaacgtaacggttacggtacccgttaccgtacggtacgaaccggtacccggaaaggtcccttacccggcccccgtttacgggtaccttaacccttcccgtttacccggttacccccgtccccgtttacccgtaacccttaaccgtttaaccgttaacgttcggtaaccgtttaacgggtaccgggaccggggttacccgtacggggtaccgaaacgggggtaccccgtacgttaaaccgttacggtcgacgttagctaacgcgacggtactacgtnac

SEQ ID NO: 199878 - DNA, 666 bp, Homo sapiens
  misc_feature: GYAE6OF02FWUK1.10.76.G10.1.454.CMB.1.raw
  modified_base (239)..(239): a, c, t, g, unknown or other
  misc_feature (239)..(239): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (647)..(647): a, c, t, g, unknown or other
  misc_feature (647)..(647): n is a, c, g, or t
  modified_base (654)..(654): a, c, t, g, unknown or other
  misc_feature (654)..(654): n is a, c, g, or t
  modified_base (657)..(657): a, c, t, g, unknown or other
  misc_feature (657)..(657): n is a, c, g, or t
  modified_base (659)..(660): a, c, t, g, unknown or other
  misc_feature (659)..(660): n is a, c, g, or t
  modified_base (664)..(666): a, c, t, g, unknown or other
  misc_feature (664)..(666): n is a, c, g, or t
tcagcatagtagtgcacgaccggtgctcgatttagtcactcatacagggtcctgggcccagtctgtgctgactcagccaccctcagcgtctgggccccccgggcagagggtctcctggacagtcagtcaccatctcctgcactggaaccagcagtgactttgttgcttataactatgtctctgtaccagcaccaccaggacaaacgccccaaactctttgtttgagtcagtagcgcctnaggactcctgattcggttctctgcctcaagtctggcaacnccggcctcctgaccgttcncgtggcctccaggctgaggatggacggtctagacttacgtacgtgacgacgcgctaagtactttacgacccgggaaccctaaacggttaaggggttcggttttacgggggaccgggtacggggaacggtttaaacgggttcggtaaacccgggttcccggttcggggtaccgaaccggtacccgtaaccgggcccgttccggtccccccgttcggtacccgtaccttaccgttccccgttcccctacccccgttccttacccctaaccgttacccttaacgtccgtaccgttacgggaacgggtcccgggtcgggttcgaccggtacgggcccgacggtaacgtaggcncgtccgngcncnngcgnnn

SEQ ID NO: 199879 - DNA, 649 bp, Homo sapiens
  misc_feature: GYAE6OF02IJP28.10.76.G10.1.454.CMB.1.raw
  modified_base (637)..(638): a, c, t, g, unknown or other
  misc_feature (637)..(638): n is a, c, g, or t
  modified_base (640)..(642): a, c, t, g, unknown or other
  misc_feature (640)..(642): n is a, c, g, or t
  modified_base (644)..(649): a, c, t, g, unknown or other
  misc_feature (644)..(649): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcacgtgggagcagaaccagcagtcggggctaggttatgattgttcagttcggtaccgccaggttccaggcacacgccccccagacctcctactaagttaatagaataaacaaaccgtaagtcccggtacccttaccggaaggggttcctaccgtacggtacccgtattcctccttcgcctacccaagtcgtcggacacctttctcggtcccctcccgtcggtactacttactcgttcggttcctccgtagggtcgaggacgtgacggtcttagtagtttactactcgacctacgtcctagtcaacaagacgctgtagttacgttgtcgttcgtcgggcgggtacgggtaacctaggttcggaccgttaccgtaacgtccgacgtacccgaaggtcccgtaccgtccccgtacgtccaccgttccgtcccgtttccccctaccctacctacctaccgttacgtcgtccgtaggaccggtcgggtccgacgggcacgggaccgtacgtactaggcnncnnncnnnnnn

SEQ ID NO: 199880 - DNA, 705 bp, Homo sapiens
  misc_feature: GYAE6OF02I2FVZ.10.76.G10.1.454.CMB.1.raw
  modified_base (692)..(692): a, c, t, g, unknown or other
  misc_feature (692)..(692): n is a, c, g, or t
  modified_base (702)..(703): a, c, t, g, unknown or other
  misc_feature (702)..(703): n is a, c, g, or t
  modified_base (705)..(705): a, c, t, g, unknown or other
  misc_feature (705)..(705): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcagtcggggcaggttatgatgttcattggtaccgccaggttccaggcacacgcccccagactcctcattaatgaataacaacaataccggccctcgacgggtctcacgaccgattctctcgcctcaagttctggctacttctcgcctcctggtctatactctcggtccttaccgagggtgaaggtatcggaagtcgtagttaatttacttaccgtacgtaccctaaccgttccttaaattacgaaaccaacgtaacgtccgttaaggtaacgtttagttttacggtcgtttaccgggttacgggtaccggggtaccgggtaacccgtaaggttacggtaaccccgttacccggttacccgtaccgtaaccgtacccggaacggtcccgtaccggtaccccccggttcggttacccgtaccgttcccgttacccggtttcccccggtccccctaacccttacccctacctaacccgttacgttccgaccgttacggacggtaccgggtcgtaccgggtaccgtaaccgggtacgaccggtaatacgccgagntacgatgcanngn

SEQ ID NO: 199881 - DNA, 649 bp, Homo sapiens
  misc_feature: GYAE6OF02IW4YV.10.76.G10.1.454.CMB.1.raw
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
  modified_base (630)..(630): a, c, t, g, unknown or other
  misc_feature (630)..(630): n is a, c, g, or t
  modified_base (633)..(633): a, c, t, g, unknown or other
  misc_feature (633)..(633): n is a, c, g, or t
  modified_base (640)..(640): a, c, t, g, unknown or other
  misc_feature (640)..(640): n is a, c, g, or t
  modified_base (642)..(643): a, c, t, g, unknown or other
  misc_feature (642)..(643): n is a, c, g, or t
  modified_base (645)..(645): a, c, t, g, unknown or other
  misc_feature (645)..(645): n is a, c, g, or t
  modified_base (647)..(648): a, c, t, g, unknown or other
  misc_feature (647)..(648): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggccaggttatggatgttcattggtaccgccaggttccaggcacacgcccccagacctcctactacttaatgactaaacaacaatccggccctcgaggggtcctccgtagaccgtattcctctcgcctccaagtcctcggtctaccttcctcgacccttcccgtggtcctatactcttcggtccgtccgtagggtgagtntagnggtctgtattacttacncgaccgtactctagtcaacgaactacgtcctagtaacgtttagtttacggcgttcgggttccgggacgggaccggtaaccgtaaggttcggacccgttacgtacgtcgaccgaccggtaacgccgttcccggtacccccgtggttaccctaccgttccgttccccggtaccccaccccgttccctacccgtacctaccgttacgtcgtccgtacggacggtccgggtacgtccggaccgtaacggtccggaacttacggacnctnagcgtcncnncncnnc

SEQ ID NO: 199882 - DNA, 686 bp, Homo sapiens
  misc_feature: GYAE6OF02HP4N5.10.76.G10.1.454.CMB.1.raw
  modified_base (672)..(672): a, c, t, g, unknown or other
  misc_feature (672)..(672): n is a, c, g, or t
  modified_base (684)..(684): a, c, t, g, unknown or other
  misc_feature (684)..(684): n is a, c, g, or t
tcagcatagtagtgcacgaccggtgctcgatttagtcactcatacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagccccacactcttgatttatgaagtcagtaagcggcctcgaggggtttctagtcgcttctctgcctccaagtctggcaacacggcctccctgacatctctgggctccgagctgacgacgaggctagaatattactgcagctcatatagtagagtggtcgtccttcttttacgtaagggttttccgggacgggtacgggtacccgagggtaccgtacggtaacccgttaccgtaacggtccgtaaacggtaccccgtaaacgggtcccgttcccggtaccccccgttccggggttaacccttacccgtttacccggtttccggtttccccccggtcccctttaccccgttccccttaaacccgtttaaccgttaccgttccggttaccggtttacgggtaaccggggtccggggtaccggttacgggtacccggtaacggggtccggtaaccggtaaggtaccggtactcggctacgtcgcgngtcgtcgtcgtntc

SEQ ID NO: 199883 - DNA, 783 bp, Homo sapiens
  misc_feature: GYAE6OF02ICXD3.10.76.G10.1.454.CMB.1.raw
  modified_base (770)..(770): a, c, t, g, unknown or other
  misc_feature (770)..(770): n is a, c, g, or t
  modified_base (774)..(774): a, c, t, g, unknown or other
  misc_feature (774)..(774): n is a, c, g, or t
  modified_base (776)..(776): a, c, t, g, unknown or other
  misc_feature (776)..(776): n is a, c, g, or t
  modified_base (778)..(778): a, c, t, g, unknown or other
  misc_feature (778)..(778): n is a, c, g, or t
  modified_base (781)..(782): a, c, t, g, unknown or other
  misc_feature (781)..(782): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcagtcgggcaggttatgatgttcagttggtaccgcgaggttccaggcacgacgcccccaagctcctctattaatgaactaaacaactaactccggccctacgtacggggtctcgtacgaccgtattcctctcgcctaccgaagtccgtggacctacttcgtcgtcccttcccgtcggtctattactcggttcggtcctaccggagggtgaggtagtggaggtcttagtatttaacgttactacggtaccctaccgttaccttaacgtacgtaacctaaacgtaccgtacccgtttagggtaacgttttaagggttttcgggttaccggtttcggggttttcccgggggacccgggggtacccggggtaaaccggttaacgggtttaacccgggtaccccggtttacccgttacggttacccgacccggtaacccggtaacgggtccgtaccccggttcccccggttaccgttacccgtacctttcccgttacccggttacccccttcccctttcccctacccgtttaacccttaaccgtttaacgttcggtaccgttccgggaccgggtacccgggtccggtcgggtaccgggtaaccgggtccgaaccgtaacgtacggctacgtcgngtgngngngcnng

SEQ ID NO: 199884 - DNA, 713 bp, Homo sapiens
  misc_feature: GYAE6OF02JRY04.10.76.G10.1.454.CMB.1.raw
  modified_base (228)..(228): a, c, t, g, unknown or other
  misc_feature (228)..(228): n is a, c, g, or t
  modified_base (694)..(694): a, c, t, g, unknown or other
  misc_feature (694)..(694): n is a, c, g, or t
  modified_base (698)..(698): a, c, t, g, unknown or other
  misc_feature (698)..(698): n is a, c, g, or t
  modified_base (700)..(700): a, c, t, g, unknown or other
  misc_feature (700)..(700): n is a, c, g, or t
  modified_base (703)..(703): a, c, t, g, unknown or other
  misc_feature (703)..(703): n is a, c, g, or t
  modified_base (705)..(706): a, c, t, g, unknown or other
  misc_feature (705)..(706): n is a, c, g, or t
  modified_base (713)..(713): a, c, t, g, unknown or other
  misc_feature (713)..(713): n is a, c, g, or t
tcagcatagtagtgcacgaccggtgctcgatttagtcactcatacagggtcctgggcccagtctgtactgacgcagccgccctcagtatctggggccccagggcagagggtctccatctcctgcactgggagcagaaccagcatcggggcaggttatgatgttcattcggtaccgccaggttccaggcacacgcccccagacctcctacattaatgaataacaacaanccggaccctcgagggtcctcgtcgaccgtattcctctcgccctaccgaacgttcgtacggactacgttctcgtcccttccgtgtctatacgttcgtcggttcctaccgtagggtacgaggtacgtaggacggtcgttaggttaactttacttaccgtccgtaccctaaccgttaccgttaagtacgtaaccaacgtacggtccgtaaggttaacggtttacgtttcggtcggtttaccggttcggggtaccgggtaccgggtaaccgttaacggttaccggtacccggttacccgtaccgttacgaccggtaccggtaaccggtccgtacccggtccccgttaccggtaccgttacccttccgttacccttccccgtaccccgttccctaccctaccttaccttgtaccgttcgtaccggtacggtccggtcggtacgaccgtacggcctaagtacgacgcgtagngacncncgncnnttttttn

SEQ ID NO: 199885 - DNA, 673 bp, Homo sapiens
  misc_feature: GYAE6OF02ILNT7.10.76.G10.1.454.CMB.1.raw
  modified_base (645)..(645): a, c, t, g, unknown or other
  misc_feature (645)..(645): n is a, c, g, or t
  modified_base (670)..(670): a, c, t, g, unknown or other
  misc_feature (670)..(670): n is a, c, g, or t
  modified_base (672)..(672): a, c, t, g, unknown or other
  misc_feature (672)..(672): n is a, c, g, or t
tcagcatagtagtgcacgaccggtgctcgatttagtcactcatacagggtcctgggcccagtctttgttgacgcagccgccctcagtgtctgcggccccaggacagagggtcaccgtctcctgctctggaagcgcctccaacattggcaacgaattatgtatcctggtaccagcaccttccccgggacacgcccccaaactcctcatctatgaagtatttacgccgtaccctcgagggtacttccgtggccgtattctcgtggcctaccgaagtcaacggcctacctctcgcccaccgtggactacgtccgaccgggcctccgacggaccggggacgacggtccgtaattacgtacgtcggccgactaacggttcggacctacctaacgtcggtacgttgggttcggggtcgtttccgggacgggaacgggtactaacgggttcgacccgttctaccggctacggcccgagtccgtccgtccccgtgtacctcctcgttccgttaccccgaccccttcctcccgtaacttaccgtacgttccgtccgttacgggccggtcccgggtacgttcccggaacggtaaccgggtcgtaccgtaacgtaacggcgttccgcgtacgcgtacgtcgtacgtcgtcgtcgcncgtacgtcgtcgtcgactcgcgtcncnc

SEQ ID NO: 199886 - DNA, 168 bp, Homo sapiens
  misc_feature: GYAE6OF02JHUQB.10.76.G10.1.454.CMB.1.raw
  modified_base (155)..(168): a, c, t, g, unknown or other
  misc_feature (155)..(168): n is a, c, g, or t
tcagcatagtagtgcacgaccggtgctcgatttagtcactcatacagggtcctgggcccagtctgtgctgactcagccaccctcagcgtctgggccccccggcagagggtctccatctctgttctgagtcacttccaacatcggaaataatgatnnnnnnnnnnnnnn

SEQ ID NO: 199887 - DNA, 837 bp, Homo sapiens
  misc_feature: GYAE6OF02HM6PS.10.76.G10.1.454.CMB.1.raw
  modified_base (134)..(134): a, c, t, g, unknown or other
  misc_feature (134)..(134): n is a, c, g, or t
  modified_base (811)..(811): a, c, t, g, unknown or other
  misc_feature (811)..(811): n is a, c, g, or t
  modified_base (832)..(832): a, c, t, g, unknown or other
  misc_feature (832)..(832): n is a, c, g, or t
tcagcatagtagtgcacgaccggtgctcgatttagtcactcatacgagggtcctgggcccagtctgtactgacgcagccgccctcagtatcgtgggccccagggcagagggtcctccatctcctgcactgggancagaccagcgagtcgggcaggttagtgacgttgttactagttacggtaccgaccgtaggttaccgaggacaccgacgcccccgagaccctcctactaacgtttaagtagtaactaaacctaaactaacgtccggtaccccttacggtacggggttaccttaccgtacggaccggtacttccgttccgttacgaccttaccgaagttccgacggtacctaccgttccgtcgtcccgttccgtagttacagttactcgttcggtaccgtacggtagggtacgacggtagtacggaggtcttaaggtaacttttacgtacgtcgaccctaccgttactacgtaacgaaccgtacgtaccggtacgttaggtaacgttttaggttccggttacggtttaccgggtaccgggtaccggggtaacccgggtaaccgttaacgggttacccggtaaccccgtttacccggttaccgtaaccgtaacggtaccccggtaaacggtcccgttcccccggttaacccggtttcgttacccgttaacccgtttccgttaaccccgtttacccccgtaacccttcccgttaaccccgtaatttacccgttaccgttacgacgggttaccgggttaccggccggttaaccggttcgggaaaccgttcgggtaaccctagttaccgaggtntaccgctacgcgttacagtcngagtc

SEQ ID NO: 199888 - DNA, 792 bp, Homo sapiens
  misc_feature: GYAE6OF02IIS0H.10.76.G10.1.454.CMB.1.raw
  modified_base (106)..(106): a, c, t, g, unknown or other
  misc_feature (106)..(106): n is a, c, g, or t
  modified_base (758)..(758): a, c, t, g, unknown or other
  misc_feature (758)..(758): n is a, c, g, or t
  modified_base (790)..(791): a, c, t, g, unknown or other
  misc_feature (790)..(791): n is a, c, g, or t
tcagcatagtagtgcacgaccggtgctcgatttagtcactcatacagggtcctgggcccagtctgtgctgactcagccaccctcagcgtcgtcgggccccccgggnaggaggtctccatctcttgttctggagtcacttccaacatcggaaatatgatgtgagcgtggtaccagcgacggtcccgaggaccggccccaaatcctcatcgtaataacgtattagcggccggcctacggtacgggtccctaggacccgtagttccgtcgtcggcctaccgaagttccgtcggacctacccgtaccgtaccgtccccttcccgtcgggaccctagttaccggacgggttcgggtacccgttacccggggtaccggaagggtacgttacggacggttaccgtacggttaactttacgtttcgtaggttacggtacgacggtaggtcggtaacgttcgaaacgtcggtaccgtttaggacgtttcggttaacttttacggttccggtttaccggttaaccgggggtaacgtttacccgggggtaaacccggtaacgggtttcccgtaacccggtttacccgtaaccggttaaccggaccccggaaacccggtaccggtaaacccccgaacccgttaccttccggaccctttaccggttcccgttttaccccgtccccaacccctttacccgcccgttaaaccttacgttacgtaccgtcgtacggtcggggtcgtccgttacgggacgacgcgtacgtatcgntcgcttacggactcgtgcaggtccagcgaccnnc

SEQ ID NO: 199889 - DNA, 695 bp, Homo sapiens
  misc_feature: GYAE6OF02F5GN8.10.76.G10.1.454.CMB.1.raw
  modified_base (598)..(598): a, c, t, g, unknown or other
  misc_feature (598)..(598): n is a, c, g, or t
  modified_base (673)..(673): a, c, t, g, unknown or other
  misc_feature (673)..(673): n is a, c, g, or t
  modified_base (683)..(683): a, c, t, g, unknown or other
  misc_feature (683)..(683): n is a, c, g, or t
  modified_base (692)..(693): a, c, t, g, unknown or other
  misc_feature (692)..(693): n is a, c, g, or t
tcagcatagtagtgcacgaccggtgctcgatttagtcactcatacagggtcctgggcccagtctgtactgacgcagccgccctcagtatctggggccccagggcaggagggtctccatctcctgcacgtgggagcagaaccagcagtcggggcgtaggttatgatgttctagttcggtaccgccgtacggttccgaggcacgaccgacccccagacctcctactaattaagtacgaaactaaaccgaaactaaacgtccggacccctacggtacggggttcctcgtacggaacctagtttcctcgtaccgcccttacgtaacggtctcggtacctaccttcgtcgtccctcccggttgtacctatacgttcgtcggttccgtaccggtaggggtgtaaggcgtggacggttctacgttaatttactcgtccgacctaccttcgtagacaacgacgtacggtctaggtacgtttcgttcggtcggttacgggtcgggccggggtacgtaacgtacgttccggtaaccgttcgaaccgtccgacgtaccgtaccggtccgtacccgtcccgtcggttcctccgttccttcccgttacccncccgttccctacgtaccttacgtcgtccgtacgtggtaccgggtccgtacgacgtaccggacggccctagtcgancgactggccngtgactgcnncg

SEQ ID NO: 199890 - DNA, 750 bp, Homo sapiens
  misc_feature: GYAE6OF02GM262.10.76.G10.1.454.CMB.1.raw
  modified_base (142)..(142): a, c, t, g, unknown or other
  misc_feature (142)..(142): n is a, c, g, or t
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
  modified_base (726)..(726): a, c, t, g, unknown or other
  misc_feature (726)..(726): n is a, c, g, or t
  modified_base (732)..(732): a, c, t, g, unknown or other
  misc_feature (732)..(732): n is a, c, g, or t
  modified_base (737)..(737): a, c, t, g, unknown or other
  misc_feature (737)..(737): n is a, c, g, or t
  modified_base (740)..(740): a, c, t, g, unknown or other
  misc_feature (740)..(740): n is a, c, g, or t
  modified_base (742)..(743): a, c, t, g, unknown or other
  misc_feature (742)..(743): n is a, c, g, or t
  modified_base (745)..(745): a, c, t, g, unknown or other
  misc_feature (745)..(745): n is a, c, g, or t
  modified_base (747)..(749): a, c, t, g, unknown or other
  misc_feature (747)..(749): n is a, c, g, or t
tcagcatagtagtgcacgaccggtgctcgatttagtcactcatacagggtcctgggcccagtctgtactgacgcagccgccctcagtatctggggccccagggcaggagggtctccatctcctgcacgtgggagcagaaccngcagtcggggcaggttatgtacttgttctagttcggtaccgcctacggttccaggcaccacgacccccagtacctcctctaacttaatgaataacaacagtccggaccctgagggtctctacgacctcttcnctcgcctcagtcgtgcctacttctcnccttacccgtgtcctagtacttcggttcgtacctaccggtaggggtgtaacggtacgtacggacggtcgtttacggtaattttaacgtttacctcggaccccttaccgttacctaacgttacgtaaaccgaacgtccgtaaccttaaggggtactttttacgtttcgggtacggtttccgggttacggggtacccgggtccgggttaaccgttacgggtttccccgggtaacccgtttaccccgtaccggtaccggtaccggtacccggaacgggttccccgtccccggttaccccgttccggtacccttcccgtttcccgtttccccgtttccccgttaacccccttcccgtaccccgttaacctttacctcgttaccgtcgttacgggaccggtacgggtccgacggtaccggactccggtaanccgtancgtangcncnncncnnnc

SEQ ID NO: 199891 - DNA, 953 bp, Homo sapiens
  misc_feature: GYAE6OF02F5VS8.10.76.G10.1.454.CMB.1.raw
  modified_base (134)..(134): a, c, t, g, unknown or other
  misc_feature (134)..(134): n is a, c, g, or t
  modified_base (400)..(400): a, c, t, g, unknown or other
  misc_feature (400)..(400): n is a, c, g, or t
  modified_base (942)..(942): a, c, t, g, unknown or other
  misc_feature (942)..(942): n is a, c, g, or t
tcagcatagtagtgcacgaccggtgctcgatttagtcactcatacagggtcctgggcccagtctgtactgacgcagccgccctcagtatctcggggcccagggcaggagggtctccatctcctgcacgtgggancacgaaccagcgacgtcgggggctagggttagtgtacgttggttactagtttacggtacccgtccgtaacgggtttccacggaccaccgaccggaccccccaaggtacccttcctacttaaacgtttaaacgtacgtaaactaaaacctaaacctaaaccgttcccggtaccccgtagggtaccggggttccttaccgtaccgtacggttaacctttccgtacttcggacccctaccgtacgttaccgtcggttcctaccgtttcnccggtcccttcccgtggtactaagttaccttccggtacggttcctaacgggtagggtacggagggtacttacggggtactcggttaagttacgttttaacgttccgtaccggtaacccttacccgttaccgtttacgaaaccgtaaaaccgtaaccggtaccgtacggtttaaacggtaaggttttacggtttacgggggtaccggttttcggggtaccgggggttacccggggtaaccgggggttaaaccggtttaacccggttaaccgggtaccccgggtttaaccgtaacccggttacccgaacccgggtaccccggttaaccgggtacccgttcccccgggttaaccccgttaacccgggttcccgttaccgtttaacccgtttcccccggtaccccgttaccccgttaccccgttacccgtaaccttaaccccgttgtacccttacgggtaccggtcgggtacccggttggaacccggtacggaacccgggtataacccgggtaagttacgacgtccgtaagcccgtatccggtccncctcggtacag

SEQ ID NO: 199892 - DNA, 895 bp, Homo sapiens
  misc_feature: GYAE6OF02JZNO6.10.76.G10.1.454.CMB.1.raw
  modified_base (273)..(273): a, c, t, g, unknown or other
  misc_feature (273)..(273): n is a, c, g, or t
tcagcatagtagtgcacgaccggtgctcgatttagtcactcatacagggtcctgggcccagtctgtgctgactcagccaccctcagcgtctcgggccccccgggcaggagggtcctccatctcttgttctggagtcacttccaacatcggaaataatgatgtgagctggtaccagcacggtccaaggaaccggccccaaactcctcatctaataccaatcgatgtacgccggtccctacggtacggggtacctcggtaacccgtatttctccncggtaccctacctaacggtccgttacgggacctacggtccgtaacggtccccttccgtacgggtaacctaccgtcccggttccgggtacccttcccgtaacggtctacggtaccgggtactaggtacggggttccttttaggtttttacgttttaaccgtccgggtttacggaaccgtccgggttaaaccgggggcgtttaacccgaccgttaaccggggaacccggggttaaagtcccggggtaaagttaacgggttttacgggggttaacgtttcccgggggaaccggggtaaacgggggtaacctttaacgggtttacgtaacccgggtccgtttaaacggaccctacggggtaccccggaggggttaaccctccccggggttacccccgttaccgggtcccgttaaccggtttacccgtttaaccccggtttcccccctaaaccccggtttcccctaacccggttaacccgtttaacctttaccggttaacgtcccggttagggaaccgggtcccggggtttaccgtaacggggaccggtaaacgaccccggggtttaagtaccgggtactaacggcgaagtacgtcgtacgtacgacgtacgcgtacgcgtctcacg

SEQ ID NO: 199893 - DNA, 227 bp, Homo sapiens
  misc_feature: GYAE6OF01D0ROW.49.89.I01.1.454.CMB.1.raw
  modified_base (221)..(227): a, c, t, g, unknown or other
  misc_feature (221)..(227): n is a, c, g, or t
tcagagtcgagagacacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtgggccctcctctctctcgactctgagcgggctggcaaggcgcatagnnnnnnn

SEQ ID NO: 199894 - DNA, 777 bp, Homo sapiens
  misc_feature: GYAE6OF01AUCAC.49.89.I01.1.454.CMB.1.raw
  modified_base (100)..(100): a, c, t, g, unknown or other
  misc_feature (100)..(100): n is a, c, g, or t
  modified_base (140)..(140): a, c, t, g, unknown or other
  misc_feature (140)..(140): n is a, c, g, or t
  modified_base (187)..(187): a, c, t, g, unknown or other
  misc_feature (187)..(187): n is a, c, g, or t
tcagagtcgagagacacgaccggtgctcgatttagtatgctagtatgggtgaccgccatggtcaacgccttcaacacccagctgaaagccggcctgggcnccgacgatgcgcgcgtgctgtacaccgactgtacaccgtnagcaacgaccaggtgaacgaacccccggccatacggcctgaccaacnccagcgtcccggctgcgccgagaatgcgctggcacgcctcgctgactctgcaccgacgaacaacgcggtcgccggtgtaatgtgacgccgactacgagttcggtccggccggacgggtactaccccgaaccccggtccccggttacgaacggaaccgaccgtctaacgtccgacccgtcgttacgttcttacgaacggactaacgtcggacccataccggtaaaggggctggggtaccttaagggtaaacggaaacggtccggtcccggaaccggggtccccgtacgggtacgtacgggtccggggtacccggggtacccttacgaccgttaccgaacctaaccgtacctaacggttaccggaaacgggaagttaacgtaaccggtcgttaaaagttacggtttaaaacgttttacgttttaacccggttttaaaccgaaaacggttaagtaaacgttaggtaacgttaacggtaaacgggttcggtacggttacgggggtttagggacggggttccggtacggggtaccggggttcccgggaggggtaacccggtaaggggtacccgacgttaacggaatcggtcgagg

SEQ ID NO: 199895 - DNA, 350 bp, Homo sapiens
  misc_feature: GYAE6OF02IU2Y0.49.89.I01.1.454.CMB.1.raw
  modified_base (343)..(350): a, c, t, g, unknown or other
  misc_feature (343)..(350): n is a, c, g, or t
tcagagtcgagagacacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctcagccaggaccaaggacagcagcctccaccaagggcccatcggtcttccccctggcaccctcctccaagagcacctctgggggcacagcggccctgggctgcctggtcaaggctacttcctctctcgactctgagcgggctggcaaggcgcatagnnnnnnnn

SEQ ID NO: 199896 - DNA, 227 bp, Homo sapiens
  misc_feature: GYAE6OF02G9RLE.49.89.I01.1.454.CMB.1.raw
  modified_base (222)..(227): a, c, t, g, unknown or other
  misc_feature (222)..(227): n is a, c, g, or t
tcagagtcgagagacacgaccggtgctcgatttagtatgctagtatgggcacgaccgacctgagctcaggaggcagcagagcgagggaggaggagaggccccaggtgaacggaggggcttgtccaggccggcagcatcaccggagcccagggcagggtcagcagtgctggccgtggggccctcctctctctcgactctgagcgggctggcaaggcgcatagnnnnnn

SEQ ID NO: 199897 - DNA, 159 bp, Homo sapiens
  misc_feature: GYAE6OF01AFSLV.1.15.B04.1.454.CMB.1.raw
  modified_base (154)..(159): a, c, t, g, unknown or other
  misc_feature (154)..(159): n is a, c, g, or t
tcagacgagtgcgtcacgaccggtgctcgatttagacagtatataaagggtaagggaccaaggtggaaatcaaacgaactgtggctgcaccatctgtcttcatcttcccgccctcctcacgcactcgtctgagcgggctggcaaggcgcatagnnnnnn

SEQ ID NO: 199898 - DNA, 154 bp, Homo sapiens
  misc_feature: GYAE6OF01EP0GP.1.15.B04.1.454.CMB.1.raw
  modified_base (154)..(154): a, c, t, g, unknown or other
  misc_feature (154)..(154): n is a, c, g, or t
tcagacgagtgcgtcacgaccggtgctcgatttagacagtatataaagggtaagggaccaaggtggaaatcaaacgaactgtggctgcaccatctgtcttcatcttcccgccatctgatatacgatcgctgagcgggctggcaaggcgcatagn

SEQ ID NO: 199899 - DNA, 154 bp, Homo sapiens
  misc_feature: GYAE6OF01BTQ0D.1.15.B04.1.454.CMB.1.raw
  modified_base (154)..(154): a, c, t, g, unknown or other
  misc_feature (154)..(154): n is a, c, g, or t
tcagacgagtgcgtcacgaccggtgctcgatttagacagtatataaagggtaagggaccaaggtggaaatcaaacgaactgtggctgcaccatctgtcttcatcttcccgccatctgaacgcactcgtctgagcgggctggcaaggcgcatagn

SEQ ID NO: 199900 - DNA, 154 bp, Homo sapiens; identical to SEQ ID NO: 199898
  misc_feature: GYAE6OF01C70S9.1.15.B04.1.454.CMB.1.raw
  modified_base (154)..(154): a, c, t, g, unknown or other
  misc_feature (154)..(154): n is a, c, g, or t

SEQ ID NO: 199901 - DNA, 154 bp, Homo sapiens; identical to SEQ ID NO: 199899
  misc_feature: GYAE6OF01ANU2S.1.15.B04.1.454.CMB.1.raw
  modified_base (154)..(154): a, c, t, g, unknown or other
  misc_feature (154)..(154): n is a, c, g, or t

SEQ ID NO: 199902 - DNA, 154 bp, Homo sapiens; identical to SEQ ID NO: 199899
  misc_feature: GYAE6OF01COQK1.1.15.B04.1.454.CMB.1.raw
  modified_base (154)..(154): a, c, t, g, unknown or other
  misc_feature (154)..(154): n is a, c, g, or t

SEQ ID NO: 199903 - DNA, 154 bp, Homo sapiens
  misc_feature: GYAE6OF01EAXHX.1.15.B04.1.454.CMB.1.raw
  modified_base (154)..(154): a, c, t, g, unknown or other
  misc_feature (154)..(154): n is a, c, g, or t
tcagacgagtgcgtcacgaccggtgctcgatttagacagtatataaagggtaagggacacgactggagattaaacgaactgtggctgcaccatctgtcttcatcttcccgccatctgaacgtctactgctgagcgggctggcaaggcgcatagn

SEQ ID NO: 199904 - DNA, 238 bp, Homo sapiens
  misc_feature: GYAE6OF01DDXMV.1.15.B04.1.454.CMB.1.raw
  modified_base (214)..(238): a, c, t, g, unknown or other
  misc_feature (214)..(238): n is a, c, g, or t
tcagacgagtgcgtcacgaccggtgctcgatttagacagtatatagtcgcgggggagaaggttttgtcagcaagacaatggagagctctcactcgtggtggacgttcggccaagggaccaaggtggaaatcaaacgactgtggctgcaccatctgtcttcatcttcccgccatctgaacgcactcgtctgagcgggtctggcaaggcgcatagnnnnnnnnnnnnnnnnnnnnnnnnn

SEQ ID NO: 199905 - DNA, 154 bp, Homo sapiens; identical to SEQ ID NO: 199903
  misc_feature: GYAE6OF01APCKK.1.15.B04.1.454.CMB.1.raw
  modified_base (154)..(154): a, c, t, g, unknown or other
  misc_feature (154)..(154): n is a, c, g, or t

SEQ ID NO: 199906 - DNA, 215 bp, Homo sapiens
  misc_feature: GYAE6OF01CQ0Q1.1.15.B04.1.454.CMB.1.raw
tcagacgagtgcgtcacgaccggtgctcgatttagacagtatatatcgcgggggagaagggtttttgttcagcaagacaatggagagctctcactgtggtggacgttcggccaagggaccaaggtggaaatcaaaacgaactgtggctgcaccatctgtcttcatcttcccgccatctgaacgcactcgtctgagcgggctggcaaggcgcatag

SEQ ID NO: 199907 - DNA, 185 bp, Homo sapiens
  misc_feature: GYAE6OF01CF3U4.1.15.B04.1.454.CMB.1.raw
  modified_base (158)..(185): a, c, t, g, unknown or other
  misc_feature (158)..(185): n is a, c, g, or t
tcagacgagtgcgtcacgaccggtgctcgatttagacagtatataaagggtaagggaccgaaggtggaaatcaaacgaactggtggctgcaccatctgtcttccatcttcccgccatctgatatacgatcgctggagcgggctggcaaggcgcatagnnnnnnnnnnnnnnnnnnnnnnnnnnnn

SEQ ID NO: 199908 - DNA, 153 bp, Homo sapiens
  misc_feature: GYAE6OF01DIHSX.1.15.B04.1.454.CMB.1.raw
tcagacgagtgcgtcacgaccggtgctcgatttagacagtatataaagggtaagggaccaaggtggaaatcaaacgaactgtggctgcaccatctgtcttcatcttcccaccctcctcacgcactcgtctgagcgggctggcaaggcgcatag

SEQ ID NO: 199909 - DNA, 154 bp, Homo sapiens; identical to SEQ ID NO: 199898
  misc_feature: GYAE6OF01CAKX0.1.15.B04.1.454.CMB.1.raw
  modified_base (154)..(154): a, c, t, g, unknown or other
  misc_feature (154)..(154): n is a, c, g, or t

SEQ ID NO: 199910 - DNA, 163 bp, Homo sapiens
  misc_feature: GYAE6OF01BPWZN.1.15.B04.1.454.CMB.1.raw
  modified_base (152)..(163): a, c, t, g, unknown or other
  misc_feature (152)..(163): n is a, c, g, or t
tcagacgagtgcgtcacgaccggtgctcgatttagacagtatataaagggtaagggaccaaggtggaaatcaaacgaactgtggctgcaccatctgtcttcatcttcccgcatctgaacgcaccgtctgagcgggctggcaaggcgcatagnnnnnnnnnnnn

SEQ ID NO: 199911 - DNA, 154 bp, Homo sapiens
  misc_feature: GYAE6OF02FOR1H.1.15.B04.1.454.CMB.1.raw
  modified_base (154)..(154): a, c, t, g, unknown or other
  misc_feature (154)..(154): n is a, c, g, or t
tcagacgagtgcgtcacgaccggtgctcgatttagacagtatataaagggtaagggaccaaggtggaaatcaaacgaactgtggctgcaccatctgtcttcatcttcccaccctcctcacgcactcgtctgagcgggctggcaaggcgcatagn

SEQ ID NO: 199912 - DNA, 154 bp, Homo sapiens; identical to SEQ ID NO: 199899
  misc_feature: GYAE6OF02IP23G.1.15.B04.1.454.CMB.1.raw
  modified_base (154)..(154): a, c, t, g, unknown or other
  misc_feature (154)..(154): n is a, c, g, or t

SEQ ID NO: 199913 - DNA, 154 bp, Homo sapiens; identical to SEQ ID NO: 199899
  misc_feature: GYAE6OF02IU82K.1.15.B04.1.454.CMB.1.raw
  modified_base (154)..(154): a, c, t, g, unknown or other
  misc_feature (154)..(154): n is a, c, g, or t

SEQ ID NO: 199914 - DNA, 213 bp, Homo sapiens
  misc_feature: GYAE6OF02HU1G3.1.15.B04.1.454.CMB.1.raw
tcagacgagtgcgtcacgaccggtgctcgatttagacagtatatatcgcgggggagaagggttttgttcagcaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatag

SEQ ID NO: 199915 - DNA, 155 bp, Homo sapiens
  misc_feature: GYAE6OF02FH2VB.1.15.B04.1.454.CMB.1.raw
  modified_base (154)..(155): a, c, t, g, unknown or other
  misc_feature (154)..(155): n is a, c, g, or t
tcagacgagtgcgtcacgaccggtgctcgatttagacagtatataaagggtaagggaccaaggtggaaatcaaacgaactgtggctgcaccatctgtcttcatcttcccgccatctgaacgcactcgtctgagcgggctggcaaggcgcatagnn

SEQ ID NO: 199916 - DNA, 200 bp, Homo sapiens
  misc_feature: GYAE6OF02H7OOM.1.15.B04.1.454.CMB.1.raw
  modified_base (161)..(162): a, c, t, g, unknown or other
  misc_feature (161)..(162): n is a, c, g, or t
  modified_base (164)..(200): a, c, t, g, unknown or other
  misc_feature (164)..(200): n is a, c, g, or t
tcagacgagtgcgtcacgaccggtgctcgatttagacagtatataaagggtaaggggacgacgactggagagttaaacgaactgtggctgcaccatctgtcttcatctttccgccatctgaaccgtctactgtctgagtcgggctggcaaggcgtcatagnntnnnnnnnnnnnnnnnnnnnnnnnnnnnnnnnnnnnnn

SEQ ID NO: 199917 - DNA, 161 bp, Homo sapiens
  misc_feature: GYAE6OF02IFDNK.1.15.B04.1.454.CMB.1.raw
  modified_base (154)..(161): a, c, t, g, unknown or other
  misc_feature (154)..(161): n is a, c, g, or t
tcagacgagtgcgtcacgaccggtgctcgatttagacagtatataaagggtaagggacacgactggagattaaacgaactgtggctgcaccatctgtcttcatcttcccgccatctgaacgtctactgctgagcgggctggcaaggcgcatagnnnnnnnn

SEQ ID NO: 199918 - DNA, 366 bp, Homo sapiens
  misc_feature: GYAE6OF01BYG2T.1.3.A03.1.454.CMB.1.raw
  modified_base (360)..(366): a, c, t, g, unknown or other
  misc_feature (360)..(366): n is a, c, g, or t
tcagacgagtgcgtcacgaccggtgctcgatttagagagcgtcacaatctctgcacagaactttcagggctgggtcaccatgaccagggacacgtccatcaaaacagcctctctggagctgaccagactgagatctgacgacacggccgtgtattactgtgcgagagagggtactacatacggtctggacgtctggggccaagggaccacggtcaccgtctcctcagcctccaccaagggcccatccgtcttccccctggccgccctgcctccaggagcacctccgagagcacagcggccctgggctgcctggtcaaggctacttcccaactcgtctgagcggctggcaaggcgcatagnnnnnnn

SEQ ID NO: 199919 - DNA, 444 bp, Homo sapiens
  misc_feature: GYAE6OF01DQ2CY.1.3.A03.1.454.CMB.1.raw
  modified_base (430)..(444): a, c, t, g, unknown or other
  misc_feature (430)..(444): n is a, c, g, or t
tcagacgagtgcgtcacgaccggtgctcgatttagagagcgtcacaatctctgcacagaactttcagggctgggtcaccatgaccagggacacgtccatcaaaacagcctctctggagctgaccagactgagatctgacgacacggccgtgtattactgtgcgagagagggtactacagtacggtctggacgtcgtggggccaagggaccacgggtcaccgtctcctcacgccctccaccgaagggccccactcccgtccttcccccgtggccgcccctgacctccgaggacgccaacccgtcgagacgcacgacggccggcccgtggggcctcggccgtagggtaccaaaggtaccttaccttcccgaacggcctaccgttcggtcgtaggacggccggggcctagggacgaaacgggccgacatagcnnnnnnnnnnnnnnn

SEQ ID NO: 199920 - DNA, 223 bp, Homo sapiens
  misc_feature: GYAE6OF01BVPHG.14.13.B02.1.454.CMB.1.raw
  modified_base (221)..(223): a, c, t, g, unknown or other
  misc_feature (221)..(223): n is a, c, g, or t
tcagcgtctagtaccacgaccggtgctcgatttagtctagcgactttgactattggggccagggaaccctggtcaccgtctcctcagcctccaccaagggcccatcggtcttcccctggcgccctgctccaggagcacctccgagagcacagcggccccgggctgcctggtcaaggactacttccgtactagacgctgagcgggctggcaaggcgcatagnnn

SEQ ID NO: 199921 - DNA, 222 bp, Homo sapiens
  misc_feature: GYAE6OF02I8IL9.14.13.B02.1.454.CMB.1.raw
  modified_base (221)..(222): a, c, t, g, unknown or other
  misc_feature (221)..(222): n is a, c, g, or t
tcagcgtctagtaccacgaccggtgctcgatttagtctagcgactttgactattggggccagggaaccctggtcaccgtctcctcagcctccaccaagggcccatcggtcttcccctggcgccctgctccaggagcacctccgagagcacagcggccccgggctgcctggtcaaggactacttccgtactagacgctgagcgggctggcaaggcgcatagnn

SEQ ID NO: 199922 - DNA, 620 bp, Homo sapiens
  misc_feature: GYAE6OF01BRLDX.42.70.G04.1.454.CMB.1.raw
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtctggaggaggcttgaagcagccgtgggggtccctgagactctcctgtgcacgcctcgtcgggttcaccgtcagtacgcaactacatgagcgtcggggtcccgccgaggcctccggaggggaacggggccggaggtcgggtctcgtagtttatttagtggcggtagaaactacatactacgcagactccggtaggaacgggccattcaccatcctacagacgacattacgaaanacatattcgtctacttanaaatcgaacngctagacgacgccgaggaccgacgggccgttagtacttacgtgtggaccgaggtacggtactagggaaaggttggtaccttaacgggtttcaccgtttaagttttccggaaccttacgggtcgggggaaccccgtaacgggggttaaaccccc

SEQ ID NO: 199923 - DNA, 629 bp, Homo sapiens
  misc_feature: GYAE6OF01A6CLD.42.70.G04.1.454.CMB.1.raw
  modified_base (462)..(462): a, c, t, g, unknown or other
  misc_feature (462)..(462): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggttcaccgtcagtagcaactacatgagctggggtcccgccaggcctccgaggggaacggggccgggaggtggggtctcgtagtttatttagtgggcggtagaaactacatactacgcagactcgtaggaacgggccattcaccatcctccagacaccattacgaaagaacactattcgtcttcttacaaatcgaaacngcctagagacgccgaaggaccacgggtccgttagtacttacgtgtacgcggagtacgggttactacgggaaaggttgggacctttaacgggttgaaccgttagtttttacgggaaccctttaaccgggtcggggggtaccccgtaaacggggggttaaaccccccgg

SEQ ID NO: 199924 - DNA, 527 bp, Homo sapiens
  misc_feature: GYAE6OF01CX61I.42.70.G04.1.454.CMB.1.raw
  modified_base (344)..(344): a, c, t, g, unknown or other
  misc_feature (344)..(344): n is a, c, g, or t
  modified_base (475)..(475): a, c, t, g, unknown or other
  misc_feature (475)..(475): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccgccgaggctccgagggaaggggccggaggtgggtctcagttattanggcggtgaaactacatactacgcagactccgtgaaggccattcacatctcagagaccattcgaagaacacattgtctcttacaaatgaacagcctagagagccgaggacacggctgtattactgtgcgagnggtcagaaagtgctacgttgctatttcgactagtcggggccagggtaacccg

SEQ ID NO: 199925 - DNA, 570 bp, Homo sapiens
  misc_feature: GYAE6OF01CWWZ4.42.70.G04.1.454.CMB.1.raw
  modified_base (409)..(409): a, c, t, g, unknown or other
  misc_feature (409)..(409): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggttcaccgtcagtagcaactacatgagctgggtcccgccgaggctccgaggggaacggggccggaggtgggtctcgagtttatttagtgggcggtagaaactacatactacgcagactccgtgaagggccattcacatctcaganaccattacgaagaacactattgtcttcttacaaatgaacagccctgaacgacgccgaaggacgaccgggtccgtagtacttacgtgtgcgagaggtctacggaaagtggaccttagttgactagtttcggaacttaggtcggggccgacggggtaaccccg

SEQ ID NO: 199926 - DNA, 635 bp, Homo sapiens
  misc_feature: GYAE6OF01CK6O6.42.70.G04.1.454.CMB.1.raw
  modified_base (304)..(304): a, c, t, g, unknown or other
  misc_feature (304)..(304): n is a, c, g, or t
  modified_base (589)..(589): a, c, t, g, unknown or other
  misc_feature (589)..(589): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgctattttaaaaggtgtccagtgtgaggtgcagctggtggagtctggaggaggcttgaagcagccgtgggggtccctgagactctcctgtgcagcctcgtgggttcaccgtcagtagcaactacatgagcgtggggtcccnccgaggcctccggaaggggaacgggggccggaggtcgggtctacgtagtttatttagtggcggtagaaactacatactacgcagtacctccggtaggaacgggccgtattccacctatcctaccaagaacgacctaagttaccgaaagaaacctactatttcgtacttacttaacaaaagttcgaaacacgtccctaggaacgacggaccgaagggaccgaaccgggtccttagttaacttcgtgtcgacggaggtacgtctacggaaagttggacttacggttnacttaagtttcgaacgttaccggtggggacccgacgggtaaccccg

SEQ ID NO: 199927 - DNA, 752 bp, Homo sapiens
  misc_feature: GYAE6OF01BF8LV.42.70.G04.1.454.CMB.1.raw
  modified_base (537)..(537): a, c, t, g, unknown or other
  misc_feature (537)..(537): n is a, c, g, or t
tcagtgacgtatgtcacgaccggtgctcgatttagtgtagtgtgaagggaaaggggggaggaggagcccagcactggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctcgtgggttccaccgtcagtacgcaactacatgagccgtcgggtccgccaggtcctaccggagggggaacgggggccgggaggtcggggttctacgtaggtttatttagtggggacggttaggaaaacctacattaaccgtaccggcgaacgtaccgtcccggttaggaacgggggtccctaagtttcccaaccctaattcccgttacccgaagtacggtaccctaagtttaccggaaaacgtaaacctacctagttttaccgtacctttccctttaanaaaacgttgaaacccgacggtcccctaggaacggaggaccccggaaagggtacccgtaaccggggtcccgtttagttaaacttaccggttgggcggaccgggaggttaccgggtaccgttaacgggtaaaggttcggggtaccttacgggtttcgccgttaaagtttcggaacccgttagggttccgggggaacccgtaagggggtaaccccccg

SEQ ID NO: 199928 - DNA, 624 bp, Homo sapiens
  misc_feature: GYAE6OF01E08BS.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctcgttggttcaccgtcagtagcaactacatgagctgggtccgccgaggcctccgaggggaaggggccggaggtcgggtctcgagtttatttagtgggcggtagaaactacatactacgcagactccggtaggaacgggccgattccaccatcctaccagacgacccattacgaaagaacactattcgtctacttacaaatcgaacagtcctagagacgaccgaaggaccgacggccgttgtaactttaccgtggtacgacggaggtaggtaccgtacggtaaaaggttggaccttacggttcgaccgttaacgttttacggaaccgtttacggacggggggtcccgaacgggggttaaacccccg

SEQ ID NO: 199929 - DNA, 574 bp, Homo sapiens
  misc_feature: GYAE6OF01A6W0V.42.70.G04.1.454.CMB.1.raw
  modified_base (299)..(299): a, c, t, g, unknown or other
  misc_feature (299)..(299): n is a, c, g, or t
  modified_base (455)..(455): a, c, t, g, unknown or other
  misc_feature (455)..(455): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccnccaggctccgaggggaacggggccggagtggggtctcgtagtttatttatgggtcggtagaaactacatactacgcagactccggtagaacgggccgattcaccatcctcagacgaccattacgaaagaacacattgtctacttacaaatgaaacngcctagacgagccgaaggaccgacgggtccgttagtaacttacgtgtacgcggaagtggtactacggaaagtgacgtacgttgacgtagttcgacttagcggggccaggggtaaccccg

SEQ ID NO: 199930 - DNA, 632 bp, Homo sapiens
  misc_feature: GYAE6OF01BV4RD.42.70.G04.1.454.CMB.1.raw
tcagtgacgtatgtcacgaccggtgctcgatttagtgtagtgtgaagggaaagggggggaggaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctgggaggaggcttgaagcagccgtggggggtccctgagactctcctgtgcagcctctgggttcaccgtcagtagcaactacatgagctgggtccgccaggctccgaggggaaggggccggaggtgggtctcagttatttagtgggcggtagaaactacatactacgcagactccgtaggaacgggccgattccacctatcctaccgagacgacctaagttaccgaaagaacactatttacgtccttacttacaaatcgaaacacgcctaggacgacgccggaggaccgaccgggtccgttagtaacttaccgtggtcgacgaggtacggtccgttaacggaaagggttggaccttaacggtttgacccgttaagttttccggaaccttacggggtcgggggacccgtaaacgggggttacccccg

SEQ ID NO: 199931 - DNA, 581 bp, Homo sapiens
  misc_feature: GYAE6OF01EC4QZ.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggttcaccgtcagtagcaactacatgagctgggtcccgccaggcctccgaggggaacggggccggagtcgggtctctagtttatttagtgggcggtagaaactacatactacgcagactccgtggaagggccgattcaccatctcagacgacctattacgaaagaacactaattgtcctcttacaaatcgaacagcctaggagacgccgaaggaccacgggtcgttgtacttacgtgtcgacgaggtacggtctacggaaagttgggacttcggttgacttatttcgacttacggtggggcccgaaggggtaaccccg

SEQ ID NO: 199932 - DNA, 698 bp, Homo sapiens
  misc_feature: GYAE6OF01AS341.42.70.G04.1.454.CMB.1.raw
  modified_base (527)..(527): a, c, t, g, unknown or other
  misc_feature (527)..(527): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctgggtggagtctgggaggaggcttgaagcagccgtggggggtccctgagactctcctgtgcagcctcgtgggttccaccgtcagtagcaactacatgacgcgtcgggtcccgcgaggcctccggaggggaacgggggccggaggtcgggtctacgtagtttatttagtgggtacggtacgaaactaacaataaccgtacgacacgtacgtccggtaggaacggggtaccgtactttaccgaaccctacttaccgtacccgaaggaacgtaaccctagttaacgaaaagaaccctaactaattcgtcctacttaacaaaagttcgaaaccngtaccgtaggaacgacggacccgggaaggtacccgacggggtacccgttagttaactttaccgtggtcggacggtaacggtacgggttacctacgggtaaaggtcgggtacttacggttgaccttaggtttacggaccttacgggtcggggacccgtaacggggtaacccg

SEQ ID NO: 199933 - DNA, 672 bp, Homo sapiens
  misc_feature: GYAE6OF01CP3IK.42.70.G04.1.454.CMB.1.raw
  modified_base (583)..(583): a, c, t, g, unknown or other
  misc_feature (583)..(583): n is a, c, g, or t
  modified_base (621)..(621): a, c, t, g, unknown or other
  misc_feature (621)..(621): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgcttattttaaaaggtgtccagtgtgaggtgcagctgggtggagtcgtgggagggaggcttagaagcaggccgtggggggtccctggacgactctcctgtcgcagcctcgtgggttccaccgtcagtacgcaactacatgagtcgtcgggtcccgaccgacggccgtaccggagggggaacggggcccgggaggtcgggtcctacgtaaggtttatttaggcgggtacggtaagtaaacctaactaataaccgtaacgcgaacgtaccgtccggtaggaacgggtaccctattaccgacctactacctaccgaagacgaacctaagttacgaaaacgtaactacctattcgtacttactaaccgaaagtacgaacacgtcctaggacgacggaccgaggaccgacggcgttagtacttgngtcgacgagtacggtcaggtaagtcggtacttacggtntaccgttagttccggaacgttgggtaccggggcccgtaacggggtaacccg

SEQ ID NO: 199934 - DNA, 662 bp, Homo sapiens
  misc_feature: GYAE6OF01BY9D3.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctaattttaaaaggtgtccagtgtgaggtgcagctgggtggagtctggaggaggcttgaagcagccgtggggggtccctgagactctcctgtgcagcctcgtgggttccaccgtcagtacgcaactacatgagctcgggtcccgccaggctccgaggggacggggccggaggtgggtctcgtagtttatttagtgggcggtagaaactacataactacgcaagacctccgtaggaacgggccgattccaccatcctcagacaccattacgaaagaactactattcgtacttcttacaaatcgaaacacgcctaggagacgaccggaacggaccgaccgggtccgttagttaacttacgtaggtacggccggtaaggtacgggtaccgtaacgggtaaaacggttcgggtaccgtttaacgggtttcgtacccttaaggtttttcggaacccgtttaacggggtcggggggtaccccgtaaacggggggttaaccccccg

SEQ ID NO: 199935 - DNA, 691 bp, Homo sapiens
  misc_feature: GYAE6OF01D3CA1.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtgggagtcgtgggaggaggcttggaagcgagccgtggggggtccctgagactctcctgtgcacgcctctgggttccaccgtcagtacgcaactacatgagcgtggggtcccgccgaggcctaccggagggggaacggggccggaggtcgggtctcgtagtttatttagtgggtacggtagtaaactacataactacgcaacgtaccgtaccggtaggaacggggccctagttaccaacccgtatcccgtaccgaagacgtaccctaagttacgaaacgtaaaccgactaatttcgtacctacctttaacaaaatcgtaaaccacggtaccctaggaacgtacggacccggaacgggaccgaccgggtcccgttagttacttaccgtgtacgacggtaggacgggtacctaagggaaacggttcggtacgttacgttagtaccttagtttacggaccttacgggtcggggacccgtaacgggggtaaccccg

SEQ ID NO: 199936 - DNA, 715 bp, Homo sapiens
  misc_feature: GYAE6OF01COS4F.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtcgtggaggaggcttgaagcagccgtggggggtccctgagactctcctgtgcagcctcgtgggttccaccgtcagtacgacaactacatgagtcgtcggggtcccgccgacggcctaccggaagggggacggggccggaggtgggtctcgtagtttattagtggtccgtagtaaacctacaatacgtacgcacgactccggtagaacgggccgtattaccacctatcctaccaagacacctaagttaccgaaagtaaccactatttacgtcccttacttaacaaaagttcgaaacctggtaccccgtaggaacggtaacggaccccggaaggacccgtaaccggggtacccgttagttaaccgttacggtgtacggacggtaaggtacgggttacctaagggtaaacggttcgggtaacctttaaccgggttggaacctttaaggttttaccggaaacccgttaccggggtaccggggggtacccgtaaaccgggggtttaaaccccccg

SEQ ID NO: 199937 - DNA, 729 bp, Homo sapiens
  misc_feature: GYAE6OF01DZ1NP.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtgggggtccctgagactctcctgtgcagcctctgggttcaccgtcagtagccaactacatgagctcgggtccgccaggctccgaggggaacggggccggagtgggtctcgtagttattagtgggcggtagaaactacattaacctacggcctaagaccgttaccggtaggaaacggggccctaagtttccaacccgtattacccgtacccgaaggtaaccgtaaccctaacgtttaaccggaaaacgtaaaccctaacctaagttttacggttaccctttacctttaaccgaaaaattcggaaaacctacggcccctttaagggaacggtaccggaacccgggaagggaacccgtaaccggggtcccgttaaggttaacttaaccgtggtacggtacggtaagggacgggttcctaaccgggaaaaggtttcggaccgtttaacggttcgacttagtttcggaaacctttaccggtcgggggacctaacggggtaaccccg

SEQ ID NO: 199938 - DNA, 613 bp, Homo sapiens
  misc_feature: GYAE6OF01C7XJ5.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctcgtgggttcaccgtcagtagcaactacatgagcgtgggtccgccgaggctccgaggggaacggggccggaggtgggtctctagttattagtggcggtagaaactacatactacgcagactccgtgaacgggcctatcacatcctacagacgacctattacgaaagaacacgtattcgtactacttacaaatcgaacagcctaggagacggaccgaaggaccctaacgggtccgttagtaacgtttacgtggtacgaccggaaggtacggttccgaacggtaaaaggtcggtaaccttacggttgaccttagtttcggaacttacgggtcggggacccgaacggggtaaccccg

SEQ ID NO: 199939 - DNA, 760 bp, Homo sapiens
  misc_feature: GYAE6OF01BRXL0.42.70.G04.1.454.CMB.1.raw
tcagtgacgtatgtcacgaccggtgctcgatttagtgtagtgtgaagggaaaggggggagaggagcccagcactgggattccgaggtgtttccattcggtgatcagcactgaacacagaggactcaccatggtagttttggctgagtcttgggttttccttgttgtacttaagttttaaaaggtgtccagtgtgaggtgcagcgtggtggagtcgtgggaggaggcttagaagcgagccggtgggggtccctgacgacctctcctgtcgcagcctcgtcggttccaccgtcagtacgcaactacatgacgtcgtcgggtcccgaccgacggccgtaccggaaggggtaacggggccggtaggttcgggtcttacgtaagtttagtttaggtcgggtacggttaagtaaaaccttaacgtaacgtaaccgttaacggaccgtaacggtaacccgttaccggtaggaaacccggggtcccgtaacgtttacccaacccgtaacttcccgtaaccgaaggaacccgtaacctaacgtttaaccgaaaacgtaaacctaacttagtttccgttaccttacttaacaaaagtcgaaacgtcgacccgtaggaacgacggacccggaaggtacccgaccggggtaccgttagtaacctttacggaggtacgacggtaggtacggttaaccgttacgggaaaggttcggtaaccgttacgttgacttaagtttcggacgttacgggcgggaaccgtacgggtacccg

SEQ ID NO: 199940 - DNA, 645 bp, Homo sapiens
  misc_feature: GYAE6OF01BUE7A.42.70.G04.1.454.CMB.1.raw
  modified_base (373)..(373): a, c, t, g, unknown or other
  misc_feature (373)..(373): n is a, c, g, or t
  modified_base (450)..(450): a, c, t, g, unknown or other
  misc_feature (450)..(450): n is a, c, g, or t
  modified_base (532)..(532): a, c, t, g, unknown or other
  misc_feature (532)..(532): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggtttttccttgttgcttattttaaaaggtgtccagtgtgaggtgcagctggtggagtctgggaggaggcttgaagcagccgtggggggtccctgagactctcctgtgcagcctcgtgggttccaccgtcagtacgcaactacatgagcgtcgggtccgccgaggcctccggaggggaacggggccggaggtcgggtctcgtagtttatttagtggacggtanaaactacatactacgacagtacctccggtagaacgggcctattccaaccatcctaccagacgacctagttacgaaanaacactattcgtaccttacttaacaaatcgaacacgcctagacgacgccggaaggaccgacgggtccgttagttacttacgnggtacggcggaggtacggttaccgtaaggaaagggttcggacgtttacgggttcgtacttagttttaccggaacgtttaccggtccgggggaacccgtaacggggtaaccccg

SEQ ID NO: 199941 - DNA, 759 bp, Homo sapiens
  misc_feature: GYAE6OF01EEIEM.42.70.G04.1.454.CMB.1.raw
tcagtgacgtatgtcacgaccggtgctcgatttagtgtagtgtgaaggggaaaggggggggagaggagcccagcactgggattccgaggtgtttccattcggtgatcagcactgaacacagaggactcaccatggagttttggctgagcgttggttttcttgttgcttattttaaaaggtgtcagtgtgaggtgcagctgggtggagtcgtgggaggaggcttgaagcaggccggtggggggtccctgacgtactcctcctgtgcacgtcctcgttcgggttccaccgtcaagtacgaccaactacatgagcgtcgggtcccgcgacggccgtaccggaaggggggaacgggggccgggtaggtcgggtactcgtagtttagtttagtgggtacgtaagaaactacaactacgtacgcgagtccgtacggtacggaacgggtcctattaccaacctactccgtaccgaagtaaccgtacctaagttaaccggaaaataaccacttagtttaccgtaccttacttaaaccgaaagttaccgaaactacggaccttaaggaacgggtacgaacccgggaacggtacccgaccgggttcggtttacgttaacgttacgtgggttacggacggtaagggtccgttaacggttaacggtaaaacgggttcggttaaccgttacgggttcgtaccgttaacgttttaccgggaaaccggtttacgggggtaccgggggaccccgtaaccggggggttaacccccg

SEQ ID NO: 199942 - DNA, 682 bp, Homo sapiens
  misc_feature: GYAE6OF01CYRRD.42.70.G04.1.454.CMB.1.raw
  modified_base (276)..(276): a, c, t, g, unknown or other
  misc_feature (276)..(276): n is a, c, g, or t
  modified_base (367)..(367): a, c, t, g, unknown or other
  misc_feature (367)..(367): n is a, c, g, or t
tcagtgacgtatgtcacgaccggtgctcgatttagtgtagtgtgaagggaaaggggggagaggagcccagcactgggattccgaggtgtttccattcggtgatcagcactgaacacagagactcaccatggagttttggctgagcgttgggttttccttgttgctaattttaaaaggtgtccagtgtgaggtgcagctggtggagtctggaggaggcttgaagcagccgtcgggggtccctgagactctcctgtgcagcctcgtgggttcaccgtnagtagcaactacatgagcgtcgggtcccgccgaggcctaccgaagggggaacggggcccggaggttcgggtcctagtaagtttagtttagngggcggttagaaaactacataacgtacgacaagtacctccggaggaaacggcccgtaattccaacccattccaccgaagacgtaacctagttacgaaagtaacactaagttcgtactacttacaaaattcgaaacacggcctaggaacgacggaccgtaagggacccaacgggtccttaggttattacgtgtacggacgagaggttacctaacgggaaaacggttgggacctttaacgggttcgtacgttaaacgttttcgggaacccttaaacggggttccgggggaaccccgaaacggggttaaaccccccgg

SEQ ID NO: 199943 - DNA, 677 bp, Homo sapiens
  misc_feature: GYAE6OF01EVJX4.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctgggtggagtcgtggagggaggcttgaagcgagccgtcggggggtccctgacgtactctcctgtgcacgcctcgtgggttccaccgtcagtacgacaactacatgacgcgtcgggtcccgccgacgggcctaccggagggggacggggccgggaggtcgggtctcgtagtttattagtgggtacgtagaaactacatactacgacgagtaccgtcgtagaacgggcctatccaacctactcctaccaagacgtaaccctattaacgaaactaacactaagtttcgtacccttacttaacaaaagttacgaaacgtacgaccgttaggaacgaccggacccgggtaacgggaacccgtaccggggtaccgtttaggttaatttaccggtggtacggccggtaaggtcggtacgtaacggtaaagtcggtacttacggttcgattacgttcgaacgtacgggtcgggccgaacgggtacccg

SEQ ID NO: 199944 - DNA, 901 bp, Homo sapiens
  misc_feature: GYAE6OF01B278C.42.70.G04.1.454.CMB.1.raw
tcagtgacgtatgtcacgaccggtgctcgatttagtgtagtgtgaagggaaagggggggaggaggagcccagcactgggattccgaggttgtttccattcggtgatcagcactgaacacagaggactcaccagtggtagtttggctgagtcgttgggttttccttgttgtcttaagttttaaaaggtgtccagtgtggaggtgcagcgtgggtggagtcgtgggagggaggtcgttaggaagcgacggtcccgggttcggggggtcccctggacgtaccttcctccgtggtcgcacgtcccttcggttcgggttccacccgtcgaagtacgacctaaacctacagtggacgtcgtcggggtcccgccgacggtccgtaccggaagggggaacgggggccggtagggttcgggtctacgtaagttttagtttaggtcgggtacggtaacgtaaaaccgtactaacgttaaccgtaacggacgtaacggtaacccgtaccgggtaacgggaaccggggtacccgtaacgtttacccgaaccctacgttacccgtaccgaagggtaaccctaaacccttaagttaacggaaaacgtaaaccctaacgtttacgttttccgttaccctttacctttaaacgaaaaagttccggaaaaccgtacggtacccgtaagggaaccggtaaccgggacccgggaagggtaacccccgtaccggggttcccgtttaagttaacctttaaccggtgggtaacccgggaacggtaacgggttaccggttaaccgttaaaacgggttaaaggtttccgggtaaccctttacgggttacgtaacttttacggttttacgaaccccggtttaacgggggtcccgggggaacccgttaacccgggggttaaaccccg

SEQ ID NO: 199945 - DNA, 659 bp, Homo sapiens
  misc_feature: GYAE6OF01CZ7OK.42.70.G04.1.454.CMB.1.raw
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggagcttgaagcagccgtgggggtccctgagactctcctgtcgcacgtcctcgttcgggttcaccgtcagtacgcaactacagtgagcgtgggtccgccgtaggctaccggaggggaacgggccggaggtggtctcgtagtttattgnggtcggtanaaactacatactacgcgacgactcgtagaacggcctattccgaacagtcctcgaagaccgacctaagttaccgaaagtaacctacgtaagtttacgtacccttacgtttaaccaaaaacggttgaaaccgtaacgtcccgtaggtaaccggacgggtaacccgtaacgggaaccgtaccgggtccgttaggttaacttaccgtgggacgacgtaagggcgttacacgggtaaagtcggtaccttaggtcgattacttcggaaccttggcggggtacccaagggggtaacccc

SEQ ID NO: 199946 - DNA, 642 bp, Homo sapiens
  misc_feature: GYAE6OF01E3F3U.42.70.G04.1.454.CMB.1.raw
  modified_base (467)..(467): a, c, t, g, unknown or other
  misc_feature (467)..(467): n is a, c, g, or t
  modified_base (480)..(480): a, c, t, g, unknown or other
  misc_feature (480)..(480): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctgggaggaggcttgaagcagccgtggggggtccctgagactctcctgtgcagcctcgtgggtccaccgtcagtagcaactacatgagtcgtcgggtcccgccgaggcctccggagggggaacggggccggaggtgggtctcgtagtttatttagtggcggtagaactacatactacgcagacgtccggaggaacgggccgacttccaccatcctaccaagactaccagttacgaaagaaccactatttcgtccttacttanaaaagtcgaaacngcctaggaacgacggcccgaagggacccaccggggtccgttagttaacttacgtggtacgacgggtaggtacgggttcctaacggggtaaagttcgggaacctttaggttcgacttaagtttcggacccttacgggtcgggggacccaacggggttaccccg

SEQ ID NO: 199947 - DNA, 672 bp, Homo sapiens
  misc_feature: GYAE6OF01EU04E.42.70.G04.1.454.CMB.1.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (328)..(328): a, c, t, g, unknown or other
  misc_feature (328)..(328): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagtttttggctgagcggtgtttcgtgtaggcgtacttaaaagtgtcagtgtgaggtgcagctggtgagtctggaggaggcttgaagcagccgtggggggtccctgagctctcctggngacagcctgtgggttcacccggttnagtacacaacgtanatgcgtcgtcggccgcgacgcgcggacgggacgggcggnggtcggtcgtcgtagttagttagtggtacggtacgtaactaacgtacgtactacgtacgacgtacgtacggtacggaacggtacgtacgtactaccgtactactacgaacgtacgtacgtaacgtaacgaaacgtaactaactacgttacgttacttacttaacgtaacgtaacgaacgtacgtacgtacgacggacggaaccggaacggacggtaccggtacgttacgttacgttacgtagtacggacggtaggtacggtacgtaacggtacggtacggtacgttacgttacgtacgttacgttacgtacggtacgggtaccgggtaccggtaccggtaccgg

SEQ ID NO: 199948 - DNA, 585 bp, Homo sapiens
  misc_feature: GYAE6OF01BRFUZ.42.70.G04.1.454.CMB.1.raw
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
tcagtgacgtatgtcacgaccggtgctcgatttagtgtagtgtgaagggaaaggggggagaggagcccagcactgggattccgaggtgtttccattcggtgatcagcactgaacacagaggactcaccatggagttttggctgagcgtggtttcgtgttagctatttaaaaggtgtccagtgtgaggtgcagctggtggagtctggaggaggcttgaagcagcctggggggtccctgagactctcctgtgcagcctctgggttcaccgtcagtagcaactacatgagctgggtccnccaggctccgaggggaaggggccgagtgggtctcagtttattangggnggtcgaaacgtacatactacggcaggactccgtagaacgggccgattccacatctccagacgaccattacgaagtaacaacacttgtctacttacaaatcgtaacacgcctaggagacgccgaacggtacgacgggtcccgtagttaagttcgtagtgaccggtagacggtactaccggaaaggtggaccgtacgttcggactatttcggacttaccgtagggcccgtaaggggtaccccg

SEQ ID NO: 199949 - DNA, 594 bp, Homo sapiens
  misc_feature: GYAE6OF01BMG4B.42.70.G04.1.454.CMB.1.raw
  modified_base (501)..(501): a, c, t, g, unknown or other
  misc_feature (501)..(501): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctggttcaccgtcagtagcaactacatgagctgggtccgccgaggctccgaggggaaggggccggagtgggtctcagtttattagtggcggtagaaactacatacgtacgcaagacctccggtagaacgggccgattcaccatctaccagacgaccattacgaaagaacactattcgtctactactaaatgaacacgcctgacgacgccggaacggaccgacgggtccgttagtacttacgngtggacgaggtacggtacgtacggaaacggtggtacttacggttgacttagtttcggaacgttaccgtgggggaccctaacggggtaaccccg

SEQ ID NO: 199950 - DNA, 616 bp, Homo sapiens
  misc_feature: GYAE6OF01EWYUN.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccgccaggctccgaggggaaggggccggaggtgggtctcagtttatttatgggcggtagaaactacataactacgcagactccggtgaacggggccgattccaccattctccaggacgaccctattaccgaaagaacccaactatttcgtacttcttacaaattgaaactggccttaggacgtacgcccggaagggacccaacgggtcccgttagtaactttacgtggtgacggtaggtacggttctaccgggaaaggttggaccgttacggttgacttagtttcgaccttacgggtcgggggacccaacgggtaccccg

SEQ ID NO: 199951 - DNA, 865 bp, Homo sapiens
  misc_feature: GYAE6OF01D0JCL.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgcttattttaaaaggtgtccagtgtgaggtgcagctggtggagtcgtggaggaggcttgaagcagccgtgggggtccctgagacctctcctgtgcagcctcgtcggttccaccgtcagtagacaactacatggacgcgtcgggtcccgccgaggcctaccggaagggggaacgggggcccgggtaggtcggggttaccttacgtaaggttttacttttaggtcgggtaccggttaacgtaaaacttacgaattaaccgtaaccggacaacggtaccgttaccgggtaacggaaacggggtccccgtaacgttttacccaacccgtaacttacccgtacccgaacggtaaccggaaaccccttaagtttaacccgggaaaaacgtaaacccctaaacgtaacgtttttccggttaccctttaacgttttaaaccctaaaagttaccggaaaaccctacggtaaccccgttaggaaccgggtaaccgggacccggaacggggtaaccccgtaacccggggtacccgggtttaacgtttaagtttacccggtagggtttcggaaccggtaagggttaaccggttaccgtaaacgggttaaaagggttcgggttaacccgtttaacgggtttccgaccgtttaagtttccgggaaaccgttacggggttacccgggggtacccggtaaacggggttaaccccccgg

SEQ ID NO: 199952 - DNA, 691 bp, Homo sapiens
  misc_feature: GYAE6OF01EVZXM.42.70.G04.1.454.CMB.1.raw
tcagtgacgtatgtcacgaccggtgctcgatttagtgtagtgtgaagggaaagggggggagaggagcccagcactgggattccgaggtgtttcctattcggtgatcagcactgaacacagaggactcaccatggagttttggctgagctgggttttccttgttgctagttttaaaaggtgtccagtgtgaggtgcagctggtggagtcgtgggaggaggcttgaagcaggccgtggggggtccctggacgacctcctccgtgtgcacgccgtcgtgggttccaccgtcagtacgacaactacatgacgcgtcgggtcccgccgacgggcctaccggagggggaacgggggccggtaggtcgggtcttacgtaggtttagttagtcgggacggttagaaactagtactaacgtacgcgaagtacctccggtaggaacgggtccgtattaccaaccgtacttccgacctaggaccgtacctaagttacgaaaacactacgtatttgaccttacttaacgaaagttcgaaacgtacgcccgtaggacggaacggcccggaaggaacccgtaccgggttaccgttagttaaccgttcgtaggtcgaacggtacggtaggtccgtaacggaaggttgtaccttaggttcgaacttggtttacgacccttaggggtccgggaacctacggggtaccc

SEQ ID NO: 199953 - DNA, 630 bp, Homo sapiens
  misc_feature: GYAE6OF01ELY41.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtctggaggaggcttgaagcagccgtggggggtccctgagactctcctgtgcagcctcgtgggttccaccgtcagtagcaactacatgagcgtcgggtcccgccgaggcctccggaggggaacgggggccggaggtcggggtctcgtagtttatttagtgggtcggtagaaactacagtactacgcgagacctccggtaggaacgggccgtattccaacctatccgtaccaagacgtaacctagttaccgaaacgtaacactattcgtaccttacttactaaatcgaacacgacctaggagacggaccgaaggaccgaccgggtcgttagtacttacgtgtggacggagtcgggtacaggtaaggtcggacgttcgttcgcttaagtttcgacgttacgggtcgggaccggtaccgggtaccccgg

SEQ ID NO: 199954 - DNA, 936 bp, Homo sapiens
  misc_feature: GYAE6OF01B1E6V.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcttgggttttccttgttgacttattttaaaaggtgtccagtgtgaggtgcagcgtggtggagtcgtgggaggaggtcgttagaagcgaggccggtggggggtccctggacgtacctctccgtggtgcgtacgtccgtcgttcgggttaccaccgttacgagtaacgactaaacctagaatcggacggtccggttcggggtaccccgccggagggtacccgtaccggggaacggggggaacgggggtaccgggtaagggtcggggttacctaccggttaaggttttaagttttaacggtaggggtaacggttaacgtaaaaaccgttactaaacgttaaccgtaacggacgtaacggtaccgttaccgggtaagggaaacggggtacccgtaaacgttccctaaacctacgtttacccaaccgtaacggtaaccggtaaacccttacggtttaacgggaaaacctaaaccctaacgttaacgttttccgttaaacctttaacccgtttaaacgtaaaaacgttaccgtaaaaccgaccggttaccccgtaaggaaaccgggtaaccgggtaacccggaaccggggtaaccgaacccggggtttaccgtaaggtttaccgttaacgttcggggaacgggtaaccggttaagggtaccgggtttaaccggtaaacggtaaacgggttcccgggtacgttttaacgggtaacgttaccttaaaggttttcccgggaacgttttaacccggggaccgggggtaaccccggtaaaccggggtttaaacccccgg

SEQ ID NO: 199955 - DNA, 982 bp, Homo sapiens
  misc_feature: GYAE6OF01EU0AM.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcgttggttttccttgttgtacttaagttttaaaaggtgtccagtgtgaggtgcagcgtggtggagtcgtgggaggtaggtcgttagaagcaggccggttcgggggtccctgacgtacctcctcctgtcgcacgtccttcggttcggggttaccaacccgtacgtaaggttaacgaccctaaacttaaccgagtacggtaacgccggttcgggggtacccccgaccggaacgggtcccgttacccggggaaaggggggaacgggggtacccggtaggttcggggtacctacgttagtttacgttttaggcgggtacggtaacgtaaaacctaacacttaaaccgtaccggacgtaacgtaacgttcccggaaggaaccggggtaccctaacttacccgaactacctttacccgaaccgaacggtaaccgtaaacccgttaagttaaccggaaaacgaaaaccctaaacgttacgtttacggttaccctttaacccgttaaaccgtaaaaagtcgtaaaacccggtaaccggtacccgttaagggaaacgttaacccggggaaccccggtaaacgggggtaaacccccgtaacccggggttacccggtttaaacggttttaacgtttaaaccggttcgggtacggtaaccgggtaaacgggttaaaccggggttaccttaaaaccgggtaaaacggggtttaccgggttaacccggttttaacggtttacccgggaaaccttttaaacgggttttaacccggaacccgggtttaaacccggggtttcccgggggggaaaaccccggggttaacccgggggttaaaacccccccggg

SEQ ID NO: 199956 - DNA, 684 bp, Homo sapiens
  misc_feature: GYAE6OF01EXUT1.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtctggaggaggcttgaagcagccgtgggggtccctgagactctcctgtgcagcctcgtgggttcaccgtcagtacgcaactacatgagcgtcgggtcccgccgaggccgtaccggagggggaacggggccggaggtcgggtctcgtagtttatttagtcgggtacggtacgaaactacaataacgtacgacagacgtccggtaggaacgggccgtattaccacctactacctacccaaggaaccgtaaccctaagtttaccggaaaacgtaaaccctactaagttttcgtacccttacctttaacaaaattcgaaacctacgacccgttagggaacgacggcccggaagggacccgaccggggtcccgttagttacttaccgtaggtgacggtaggtacggtctaacggaaggttggacttaacggttgaccttagtttcggaaccttagggccgggggtacccaacgggggtaacccc

SEQ ID NO: 199957 - DNA, 735 bp, Homo sapiens
  misc_feature: GYAE6OF01EROD6.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagtttggctgagctgggttttccttgttgcttattttaaaaggtgtccagtgtgaggtgcagctgggtggagtcgtgggaggaggcttgaagcagccgtggggggtccctgacgactcctcctgtgcacgcctcgtgggttccaccgtcagtacgacaactacatgagcgtcggggtcccgccgaggcctaccggagggggaaggggcccggtaggtcgggttctcgtagtttatttagtcgggacggtagaaactacaataccgtacgcaagtaccgtaccggtaggaacgggtcctaacttaccaaccctacttccgtacccgaagaaccgtaaccctaacgttacgaaaacgaacctaactacttcgtaccttcttaacaaaatcgaaacacgtcccgtaggaacgaacggacccggaacgggaccgtaccggggtacccgtttagttaacgttacgtcggtacggaccggtaagggtaccgggtcgttaaaccgggaaacgggttgggtaccctttacgggttcggtaacttacgtttttaacggacccggtttaaccgggtccgggggtaccccggtaaccggggttaaacccccgg

SEQ ID NO: 199958 - DNA, 610 bp, Homo sapiens
  misc_feature: GYAE6OF01ERPYP.42.70.G04.1.454.CMB.1.raw
  modified_base (307)..(307): a, c, t, g, unknown or other
  misc_feature (307)..(307): n is a, c, g, or t
tcagtgacgtatgtcacgaccggtgctcgatttagtgtagtgtgaagggaaagggggggaggaggagcccagcactgggattccgaggtgtttccattcggtgatcagcactgaacacagaggactcaccatggagttttggctgagcttgggttttccttgttgcttaattttaaaaggtgtccagtgtgaggtgcagctggtggagtctgggaggaggcttgaagcagccgtggggggtccctgagactctcctgtgcacgcctcgtgggttcaccgtcagtagacaactacatgagctggtccncaggctccggaggggagggccggagtgggtctcgtagtttatttagtcggacggtagaaacctacaattactacgcaacgaccgtccggtaggaacgggccattaccacctactcctaccagacacctattacgaaacgaacactatttgtacttactacaaatcgaactagcctagacgacggccgaagaccgacggtccgttagtacttacgtgcgcggaaggtaggtacctacggaaagttggtaccttggttacgcttaagtttcggaaccttacggcggggtaccgacgggtaacccg

SEQ ID NO: 199959 - DNA, 615 bp, Homo sapiens
  misc_feature: GYAE6OF01D62K7.42.70.G04.1.454.CMB.1.raw
  modified_base (365)..(365): a, c, t, g, unknown or other
  misc_feature (365)..(365): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
  modified_base (462)..(462): a, c, t, g, unknown or other
  misc_feature (462)..(462): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtctggaggaggcttgaagcagccgtggggggtccctgagctctcctgtgcagcctcgtgggttcaccgtcagtagcaactacatgagcgtgggtccgccgtaggcctccggaggggaaggggccggaggtcgggtctcgagtttatttagtgggcggtanaaactacatactacgcagacctcgaggaacggccgtattcaccntcctcagagtaccattacgaanaactactattgtctacttacaaatcgaaacngctgagacgtcccgaaggaccgacgggtccgttagttacttacgtggtacgacgaaggtaccggtacttacggtaaagtttcggacttacggttacgacttaagttttcggaaacgttacgggtaccgggggccgtaacggggtaacccccgg

SEQ ID NO: 199960 - DNA, 794 bp, Homo sapiens
  misc_feature: GYAE6OF01D4UCX.42.70.G04.1.454.CMB.1.raw
  modified_base (340)..(340): a, c, t, g, unknown or other
  misc_feature (340)..(340): n is a, c, g, or t
  modified_base (582)..(582): a, c, t, g, unknown or other
  misc_feature (582)..(582): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttgctgagtcttgggttttccttgttgtcttaattttaaaaggtgtcagtgtgaggtgcagcgtggtggagtcgtgggaggaggtcgttagaagcgacggccggttcggggggtccctggacgtacctccttccgtgtcgccgtacgtccttcgttgggttccaccgtcagtacgactaactacatgacgcgtcgggtcccncgaggccgtacggaggggacggggccggtaggttcgggtcttacgttaagtttagttttacggtgggtacggttaacgaaaaccttacgtaacttaacgtacgaccgtaagtacccgttacggtaacgggaacggggtccgtactttacccgaaccctacgttaccgtccgaaaggaacgtaaccctagttaaccggaaaacgtaacctaacgttgttttaaccgtcctttaccgtttaaanaaaacgtccgaaacgtaccgtacgttaggaacggtcccgacggtaagggaccctacggggtcgttacttaagttccgtggtacggacgtacggtacggttaaccaaggggtaaacgttcggaaacccgtttttgggtacgtaaccttttagggttaccggaaacccgtttacgggggacccgggggtaactaaacccgggggttaaccccgg

SEQ ID NO: 199961 - DNA, 666 bp, Homo sapiens
  misc_feature: GYAE6OF01DUBMY.42.70.G04.1.454.CMB.1.raw
  modified_base (365)..(365): a, c, t, g, unknown or other
  misc_feature (365)..(365): n is a, c, g, or t
  modified_base (573)..(573): a, c, t, g, unknown or other
  misc_feature (573)..(573): n is a, c, g, or t
  modified_base (585)..(585): a, c, t, g, unknown or other
  misc_feature (585)..(585): n is a, c, g, or t
  modified_base (620)..(620): a, c, t, g, unknown or other
  misc_feature (620)..(620): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgctattttaaaaggtgtccagtgtgaggtgcagctggtggagtctggaggaggcttgaagcagccgtggggggtccctgagacctctcctgtgcagcctcgtggttcaccgtcagtacgacaactacatgacgcgtcgggtccgccgaggcctaccggaaggggaacggggccggaggtcgggtctacgtagtttatttagnggtacggtagaaactacaatactacgacaagtacctcggtaggaacgggccgtaacttccaacctactcctacccgaaggacaacctaacgttaacggaaacgtaaactactatttcggttaccttacgtttaactaaaagtcgaaaccgacgtaccgtagaacgacggcccgggaaggaccgacgggtcccgttagttaacttacgnggtgacgtaggnggtaccgtaaggaaacggtgtaccgttggttacgnttacgtttacgaccgttacgggtcggggaccgaacgggtaaccccg

SEQ ID NO: 199962 - DNA, 759 bp, Homo sapiens
  misc_feature: GYAE6OF01BEUYK.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcttgggttttccttgttgcttagttttaaaaggtgtccagtgtgaggtgcagctgggtggagtcgtgggaggaggtcgttagaagcaggcccggttgggggtcccctgacgtacttcctccgtgtcgacacgtcctcgttcggttccaaccgtcaagtacgacaaactacagttcggacgtcgtcggggtcccgaccgaggtacctaccgggacggggaacgggggtccggtaggttcgggttacctgtaagtttaagtttaggtacgggtacgtaagtaaacctaacgacgttaaccgtacgtaaccgaacgtacccgtaccggtacggaaaccgggtcccgtaaacttccggaaccctacgttacctaccgaacgaacgtaccctaagttaaccggaaacgtaaccaactagttcgtaccttacgttaacaaagtacgaaacgcgtaccgtgaaggcgtaacccgaggaccgtaccgggtacgttacgtacgttacggtcggtacgacggaggtaccggttaacgacggtaaagggtcgttacggttacggttcgtacgttaacgtttacgacggttacgaccggggtaccggtaaccgggtaacccgg

SEQ ID NO: 199963 - DNA, 777 bp, Homo sapiens
  misc_feature: GYAE6OF01BUOLE.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttatttaaaaggtgtccagtgtgaggtgcagctggtggagtctggaggaggcttgaagcgagccgtgggggtccctgacgtacctctcctgtgcacgtcctcgtggttccaccgtcgaagtacgctaactacatgagccgtgggtcccgccgacggccgtaccggaagggggaacggggccggtaggtcgggtactacgttaaggtttattttacggtggtaccggttaagtaaaaccgtacaacttaaacctaacggacgaacgtaccgttacccggtagggaaccggggtcccgtaattacccaaccgtacttcccgacctaaggacgtaacccctaagttaacggaaaacggtaaccctaaagttacttttacggtacctttaacctttaacgaaaacgttacgaaacccgtaggtaccccgttaggaaacgggtacccgggaaccggtaaacggtaaccccggtaaccgggtacccggtttagttacttaaccggtggtacgaccggtaaggtaccgtcgtaaaccggtaagttccgggtaccttacggttacgtaccttagtttaccggaaccttcgggggtccggggaaccccaagggggttacccc

SEQ ID NO: 199964 - DNA, 896 bp, Homo sapiens
  misc_feature: GYAE6OF01BP6I6.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgcttattttaaaaggtgtccagtgtgaggtgcagctgggtggagtcgtgggagggaggcgttagaagcgaggcccggtggggggtccctggacgtacctcctcctgtcgcacgcctcgttcggttccaccgtcgaagtacgactaaactacatgacgtcgtcggggtcccgaccgacggtcctaccggaacgggggaacggggcccgggtaggttcgggtacttacgtaaggttttagtttaggtcgggtacggttaacgtaaaaccgtaactaacgttaaccgtaaccggacgtaacggtaacccgttacccgggtaagggaaacccgggggtacccttaacgtttaaccccgaacccgtaaacgttccctaacccggtaagggaacccttaaaccgttaacgttaaacccgggaaaaacgttaaacccaaccgtttaattttacccgggtcctttaaacccgtttaaagaaaaacgttacccggaaaacctcggtaccccgttaaggggaaccgaaccccgggaccgggaacggggtaaaccccgtaccgggggttacccgtttaaggttttaaacttaacccgggtggtaaccgggaacgggtacggtaaacccggggttaccctaaggggtaaaaccgggtttcggtaacccggtttacggtgtacccgtttaaccgttaggaccccggtttaagggacccgggggacccgttaaagggtaacccccgg

SEQ ID NO: 199965 - DNA, 677 bp, Homo sapiens
  misc_feature: GYAE6OF01EU1AY.42.70.G04.1.454.CMB.1.raw
  modified_base (566)..(566): a, c, t, g, unknown or other
  misc_feature (566)..(566): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtcgtgggaggaggcgttgaagcaggcccgtggggggtccctggagtacctcctcctgtcgcacgcctcgtggttccaccgtcagtagcaactacatgagcgtcgggtcccgccgacggcctaccggagggggacgggggccgggtaggtcgggtctacgtagtttatttagtgggacggtagaaactacactactacgcaagccgtccggtaggaacgggcctacttaccaccactccgtaccaacgacgaacctaagtaccgaaacgaaacacttagttcgtccttacttaacgaaattcgaaacacgtacctaggacgacgaccggaaggacccgacgggtccgttaagttacttacgnggtacgacggtaggtaggtaccgtaacggtaaacggttcggtacgttacggttagtcttagtttaccggaacgttaccggggcgggggtaacccgacgggggtaaaccccg

SEQ ID NO: 199966 - DNA, 965 bp, Homo sapiens
  misc_feature: GYAE6OF01AXF4I.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctgggtggagtctggaggaggcttgaagcgaggccgtcggggggtccctggagactctcctgtgcagtcctcgtgggttccaccgtcagtacgcaactacatggacgtccgtcggggtcccgccgagggcctaccggaagggggaacggggccggtaggtcgggttctacgtagtttaagtttagtgggtaccggtagaaaaccttacaagttaaccgtaaccgacgtaacggtaccgttacccggtagggaaaccggggtcccctaagtttccccgaaaccctacgttacccgttacccgaaggaacccgtaacccttaagtttaacccgggaaaaactaaacccctacgttaaacgttttccgggtttaacccttaccggttttaaaccaaaaacggttcgtaaaaacccccgtaggttaccccccggttaaggggaaaacccgggtaaaccggggtacccccgggaaaacggggggtaacccccgaacccgggggggtttacccccggttttaaagggttttaaacccgtttttaaccccgggtaggggttacccggtaaacccgggggttaaacgggttaccgggggttttaaaccccgttaaaaccgggggtaaaaaggggttttcccggggtaaacccgttttttaaacggggtttccgaacccgtttttaaacggttttttaccgggaaaaccccgttttccccggggggtaaaccgggggggttaccccccgtaaaacccgggggggtttaaaccccccgg

SEQ ID NO: 199967 - DNA, 684 bp, Homo sapiens
  misc_feature: GYAE6OF01AHJE9.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagcgtggtggagtctgggaggaggcttgaagcagccgtgggggtccctgagctctcctgtgcagcctcgtgggttccaccgtcagtacgcaactacagtgagcgtgggtcccgccgacggctccggaggggaacggggccggaggtgggtctcgtagtttagtttagtgggtacggtagaaacctacatacgtacgacacgacgtcggtaggaacgggccgtacttaccacctactcctcaagaccgacctagttaacgaaacgaaccactagtttcgttacctactttaacaaaagtcgaaactcgcccgtagaaccgacggaccggaaggacccgaccgggtccgttagttaactttccgtagggtcggtacggtaacgggtacgggttcctaacggggtaaacgttcgggtaccgtttaacggttcgaccgtttaagttttccgaaccggttaggtaccgggggacccggtaaacggggtaacccccg

SEQ ID NO: 199968 - DNA, 703 bp, Homo sapiens
  misc_feature: GYAE6OF01CIC0U.42.70.G04.1.454.CMB.1.raw
  modified_base (452)..(452): a, c, t, g, unknown or other
  misc_feature (452)..(452): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcttgggttttccttgttgtcttaattttaaaaggtgtccagtgtgaggtgcagctgggtggagtcgtgggaggaggtcttgaagcaggccgtgggggtcctggagactctcctgtgcagtcctcgtggtccacgtcagtagacaactacatgacgcgtcgggcccgacgacggccgtccggaagggggaacgggccggtaggttcgggtctacgtaggtttaagttagtcgggacggtaagtaaacctaacgtactaacgtacgacagaccgttacggaggaacgggtcctacgttacaccgtntacctcgaacgaacgtacccaagttacgaaacgaactctaagttcgtacttactaacgtaaatcggaaactcgaccgtagaacgacgaccggaacgtaccgacgggtccgttaagttacttacggaggcggtaccgaaggtacggttaccaaagggtaaacggttcgaactttacgggtttgaccttttaacggttaacggacccgttaaccgggtaccgggggtaccctaaacccgggggttaaccccgg

SEQ ID NO: 199969 - DNA, 765 bp, Homo sapiens
  misc_feature: GYAE6OF01E10XN.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgcttattttaaaaggtgtccagtgtgaggtgcagcgtggtggagtcgtggagggaggcttagaagcgagccgtcgggggtccctgacgactctcctgtgcacgcctcgttcggtccaccgtctagtacgacaactacatgagcgtcgggtcccgccgacggcctaccggaggggaacgggggccgggtaggtcggggtcctcgttaagtttagttttagtcgggtcggtaacgaaactaactactaacgtacgcgtaacgaccgttccggtaggaacgggtccgaacttccgaacctacgtcctaaccgaaggtaaccgtaccctaagtttaccggaaaacgtaacctactagtttcgtacccttacgtttaaacaaattcgaaaaccctcggtaccccgttaggggaaaccgtaccggaacgggtaacggaacccggacccgggttacgttagtttaacttacgtgggttaacggccggtaagggttccggtaacgtaacggggtaaaaggttcgggttacctttacgggttccgagtttaacgtttacgggaacccgtttacggggccgggggtaaaccccgaacggggtttaacccccg

SEQ ID NO: 199970 - DNA, 736 bp, Homo sapiens
  misc_feature: GYAE6OF01BCKLC.42.70.G04.1.454.CMB.1.raw
  modified_base (282)..(282): a, c, t, g, unknown or other
  misc_feature (282)..(282): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgcttattttaaaaggtgtccagtgtgaggtgcagcgtggtggagtcgtggagggaggcttagaagcaggccggtggggggtccctgagactctcctgtgcagcctcgtggttcaccgtnagtagcaactacatgacgcgtcgggtcccgccacggctccggaggggaacggggccggagtgggtcctgtagtttagttagtcgggtacggtacgtaaactacatactacgcacgtcgtacggtacggaacgggccgtacttccgaacctactacctaccaagaccgtaactacgttaacggaaagaaccttacgacttttcgtacccttacttaaccaaaagttaccgaaactacggacctaggaaccgggtaacggacccggaacgggaccgtaacccgggtacccggttagtttaactttaacggtcggttacggacgggtacggtaacgggttacccttaaagggggtacggttacgggtacttttaccgggtaccgtactttaaggttttaccggaaccgttaaccggggttcccgggggaacccggttaacccgggggttaaaccccg

SEQ ID NO: 199971 - DNA, 730 bp, Homo sapiens
  misc_feature: GYAE6OF01DCDXH.42.70.G04.1.454.CMB.1.raw
  modified_base (639)..(639): a, c, t, g, unknown or other
  misc_feature (639)..(639): n is a, c, g, or t
  modified_base (685)..(685): a, c, t, g, unknown or other
  misc_feature (685)..(685): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagtttggctgagtcgttgggttttccttgttgtacttaagttttaaaaaggtgtaccagtgtgaggtgcgagcgtggtggagtcgtggaggaggtcttgaagcgaggccggtcgggggtccctagacgtactctccgtggtcgacacgtcctcgttcggtccaccgtcaagtacgactaactactagtgacgtcgtcgggtcccgccgacgccgtcggaaggggacgggcggtaggtcggtactacgtagttattagtggtaccgtaacgtaaactacaacgtaacgtacgacgacgtaccgtacggtaggaacgggtacctacgttaccaaccctacgtacccgtaccaacggaacgtaaccctaacggttaccgaaaaataacccgacttacgttcgttaacctaacttaacgaaaagttcgaaacctaccggtacgaagaaccgggaaccgccggggaaaccgtacccgtacccggggttacgttaagttacgtttaccggnggtacggacgtaacggtacggtacgaaggtaacgtcgtacgttcgntaacgttcgtacgacggtaccgggacgggtaccctaacgggtccc

SEQ ID NO: 199972 - DNA, 678 bp, Homo sapiens
  misc_feature: GYAE6OF01C6N8S.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgcttaattttaaaaggtgtccagtgtgaggtgcagctggtggagtcgtggaggaggcttgaagcagccgtggggggtccctgagactctcctgtgcagcctcgtgggttccaccgtcagtagcaactacatgacgcgtcgggtcccgcgaggcctaccggaggggaacggggccggaggtcgggtctcgtaagtttatttagcgggtacggtagaaaacctacaactaacgtacgcaacgtaccgtccggtaggaaacgggtccgtaacttccaaccctagtaccctaccgaaggaacgaaccctaagtttaaccggaaaagtaaaccaacttagtttcgtaccttacttaacaaaattcgaaacacggtccctaggaacggacggcccgaaggaccgacgggtccgttagtacttacgtgtcggacgtaggaccggttacaaggtaaaggttcgaccgttacggttcgacttagtttcgaacttacgggcggggacccgaacggggtaaccccg

SEQ ID NO: 199973 - DNA, 708 bp, Homo sapiens
  misc_feature: GYAE6OF01EIH6G.42.70.G04.1.454.CMB.1.raw
  modified_base (500)..(500): a, c, t, g, unknown or other
  misc_feature (500)..(500): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtcgtggaggaggcttgaagcagccgtggggggtccctgagactctcctgtgcacgcctcgtgggttccaccgtcagtacgcaactacatggacgtcgtcggtccgccgaggcctaccggaggggacggggccggaggtcgggtctcgtagtttagtttagtgggtcgtagtaaactacgaactaccgacgacacgacgttccggaggaacgggcctacgttccaacctatccaccgagactaccctaagtaccgaaagaactaactagtttcgtacccttataacaaatgaaaccncgaccgtgaaggaccgccggaagggtacccgaccgggtacgttagtttaacttaccggttgggaccgtcgggaacggttacgttaccgtaaacggggtaaacgttcgggttaaccttaccggggtttagaacccttttaaggttttgggaaacccccttttagggggaccccggggggtaaccccgtaaacggggttaaccccccggg

SEQ ID NO: 199974 - DNA, 844 bp, Homo sapiens
  misc_feature: GYAE6OF01AOQVO.42.70.G04.1.454.CMB.1.raw
tcagtgacgtatgtcacgaccggtgctcgatttagtgtagtgtgaagggaaagggggggagaggagcctagcactgggattccgaggtgtttccattcggtgatcagcactgaacacagaggactcaccatggagttttggctgagcttgggttttccttgttgcttaattttaaaaggtgtccagtgtgaggtgcagctggtggagtctggaggaggtcttagaagcgacggccggtggggggtccctaggacgtaccttcctccgtgtgccgacgccttcgtgggttccaccgtcagtacgacaactacagtgagtcgtcgggtcccgccgacggccgtaccggaaggggaacggggcccgggtagggtcgggttcttacgtaaggttttagtttacggtcgggtacggtaacgaaaacctaacgtaacgtaaccgtacggacgtaacgtaccgttacccgggtaagggaaccggggtacccgtaacgttacccgaaccctaacgttacccgtaacccgaaggtaaccgtaacccttaacggttaaaccggaaaacgtaaacccttaacgttagttttaccggttaccctttaaccttaaacaaaagttaccgaaaaccgtaccgtacccgtaggaaccgacggtacccccgggaaaggtacccggtaacccggggtacggttaagtttaaccttaccgggtagtaacccggggtacggtaacgggttaccgggtaccgtaaacggggtaaacggtcggttaaccgttacggttagtaccgtttacggttttaccggacgtttaacggggtcgggtaaccccgggtaaacgggttacccccg

SEQ ID NO: 199975 - DNA, 665 bp, Homo sapiens
  misc_feature: GYAE6OF01EPR7Q.42.70.G04.1.454.CMB.1.raw
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcttgggttttccttgttgtcttaattttaaaaggtgtccagtgtgaggtgcagcgtggtggagtcgtgggaggaggtcttgaagcgacggcccggttcggggggtccctggacgtaccttccgttccgtggtgcgacgtccttcgttcgggttccaccggtcaaggtagacctaaactacataggacgtcgtcggggtcccgccgacggccgtaccgggagggggacggggccggtaggtcggtactctagtttattagtggcgtaagaaactacactacacgacacgacctcggaggaacggtcctatccaacctactcctaccgagactacctatacgaaanacntattcgtactactacaatcgaactcgacctaggacacgccggacgacgccgggtcttagttacttcgagtcggacgtagtacggtaccgtaacggaaagttgggtaaccttcgggtgtactttaacggttcgaaccgttacggggccgggggtacccaaccggggtcccg

SEQ ID NO: 199976 - DNA, 867 bp, Homo sapiens
  misc_feature: GYAE6OF01BYQ5B.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcttgggttttccttgttgtcttaattttaaaaggtgtccagtgtgaggtgcagcgtgggtggagtcgtgggaggaggtcttagaagcgacggtccggtcggggggtccctgacgtacctcctcctgtgcacgtccgttcgttcgggttaccaccgtcgaagtacgacctaactacagtaggacgtcggtcggggtcccgaccgacggtccgtaccgggaagggggaacgggggtccgggtagggttcgggtacgtacgttagtttagtttaggtcgggtacggtaacgtaaacctactaactaccgtacgacgtacgtaccgttaccggtaaggaacggggtccgtacttaccaacctactccgtaccgaacggaacctaacccgtaagttaaccggaaaacgtaacctaacgttagtttaccgttacctttaacctttaaacgaaaacgttacggaaaccgttcggacccggttaaggaaaccgggtacccggaaccccggggaaagggtaccccggtaaccccgggttacggtttaacgttaaccgtttacgggtcggttaacgggaccgggttaaagggtaccgggttaaccgttaaacggggtaaaggtttcgggtaaccgtttacgggttctaaacccggttttagttttaccggggaacccggtttaaccgggggtcccgggggtaaaccccgtaacggggggttaacccccg

SEQ ID NO: 199977 - DNA, 818 bp, Homo sapiens
  misc_feature: GYAE6OF01CAKJ2.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagcgttgggtttttccttgttgtacttaattttaaaaggtgtccagtgtgaggtgcagcgtgggtggagtcgtgggaggaggcgttgaagcacggtccggtggggtccctgacgactctccgtgtacgccacgtccgtcgttcgggttcctaaccggtacgtaacggtaacgacctaaacttaccgagtaggacggtccggtcgggtcccgaccggacggtcctacccggggaagggggacggggcccgggtaggttcggtacgttcgtaagtttatttacggaggtcggtaacgtaaactaacgtatacgacgactacgaccgttaccggaggaaccgggtcctaacgttaccaacctacttaccgtaccgtaaagaccgtaaacccgttagtaaccggaaaacgtaaacctaactttacgtttcgtaaccccttttaacgtaaactaaaacgttaccgaaaaccgtaccggtaaccctaagggaaccgaaccgggtaccggaaggaaaccccggtacccgggttacgttacgtttaaaacgttcggttaggacggtaacggtaacgggtaaccgtaccggtaacggtaaacggttcgtcgtttaacggtcgtaacgttacgtttaaccgacggttaccggggtacgggtacccggtaacgggttaaccccg

SEQ ID NO: 199978 - DNA, 913 bp, Homo sapiens
  misc_feature: GYAE6OF01BJ0D7.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagcttgggtttttccttgttgcttattttaaaaggtgtccagtgtgaggtgcagctgggtggagtcgtgggagggaggtcttggaagcgaggtccggttcgggggggtccctggacgacctccgtcctgtgcacgccttcgtcgggttccaccgttcgagtacgacctaactacagtcgacggtccgtcggggtcccgccgacgggtcccgtaccgggaggggggaacgggggtcccgggtagggttcgggtaccttacgtaggttttaacgtttaggtacggggtaccggtaacggtaaaaccttaacgtaacttaacccgtaccgtccgtaacggtacccgttaccgggtaacgggtaacccggggtcccgtactttacccgaaccctacttacccgtacccgaaaggtaacccgtaacccttaagggttaacccggaaaacgtaaaccccttaacgtttacgttttaccgtttaccctttaacccttaaaccggtaaaaattcccggaaacccgtccggtaaccgtaaggggaaacggtacccgggcccggggaaacgggtaccccgggtaacccggggttccttttaaggttaaacttaccggtgggtacgggaacgggttacgggttaaccggttaaccggttaaagggaaagggtttcccgggtaacgttttaccggttacgtaaccgtttagttttaacccgggaacggttttacccgggggccgggggttaaaccccggttaacgggggttaaccccccg

SEQ ID NO: 199979 - DNA, 847 bp, Homo sapiens
  misc_feature: GYAE6OF01BJFHM.42.70.G04.1.454.CMB.1.raw
tcagtgacgtatgtcacgaccggtgctcgatttagtgtagtgtgaagggaaaggggggagaggagcccagcactgggattccgaggtgtttccattcggtgatcagcactgaacacagaggactcaccatggagttttggctgagcttgggttttccttgttgcttaattttaaaaggtgtccagtgtgaggtgcagctggtggagtcgtgggaggaggtcttggaagcgacggccggttcggggggtccctggacgtaccttcctccgtgtcgcgacgtccgttcgttcgggttccaccgttacgaaggtacgacctaaacttaacagtaggacgtccggttccggggtcccgccgtaacgggcccgtaccggggaacggggaacgggggtcccggtaggttcgggtccttacgttaaggttttaagttttaaggtcgggttacggtaacgtaaaccgtacgtaacgttaaccgtacggtacaacgtacccgttccgggtaacggaacgggaccctagttacccgaacctacttcccgtaaccgaagtaccgtaaacccgttaagttaaccggaaaacgtaaaccctacgttaacgtttaccggttaccctttaacccgtttaaaccgtaaaacgttaccggaaaaccctacggtaccccgttaaggaaaccgggtaccgggaaccccggaaggaaccccggtaacccggggttccgttaagttacgttaacgtggtacggtaccggaggtaccggtaccgtaacgggtaaggtccggtacgttacggtacgacttaacggtttcgaacccgttacgggtcggggtaacccgtacgggtaaccccg

SEQ ID NO: 199980 - DNA, 794 bp, Homo sapiens
  misc_feature: GYAE6OF01AKDJ7.42.70.G04.1.454.CMB.1.raw
tcagtgacgtatgtcacgaccggtgctcgatttagtgtagtgtgaaggggaaagggggggagaggagcccagcacctgggattccgaggtgtttccattcggtgatcagcactgaacacagaggactcaccatggtagttttggctgagcgttgggttttccttgttgctaattttaaaaggtgtcagtgtgaggtgcagtctgggtggagtcgtgggaggaggtcttaggaaagccgtacggccggtcgggggggttccctaggacgtacctcctcccgttggtcgccacgtcccttcggttggggtttcccaccgttacgagtacgactaactacagtggacgtccggtcggtcccgccgaggtcctaccggagggaacgggggccggtaggtcgggtactagtaagtttatttaggtcgggtacggtacgaaacctaacgtactaaccgtacgacgacggtacccgtccggtaggaacggcccggtatttacccataacctcgtaaccgacgtaacggtacctaacgtaacgaaacgtaaactaacgttattacgttaccctacttaaactaaagtaccgaaacggtaccgtacggtaccggaaaggacccgggaccgggaaacgggtaaccggtacccggggtcttaacgggttacttacggtcggtaacggtcggtaaacgggtcggttaccgtaaaggggaacgttcgggtaacttcgggttacgtagttaacggtttacggaacccgttacggggtaaccgggcccggtaaaccggggttaccccgg

SEQ ID NO: 199981 - DNA, 748 bp, Homo sapiens
  misc_feature: GYAE6OF01D4T8A.42.70.G04.1.454.CMB.1.raw
  modified_base (346)..(346): a, c, t, g, unknown or other
  misc_feature (346)..(346): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcgttggttttccttgttgtacttaagttttaaaaggtgtccagtgtgaggtgcagcgtgggtggagtcgtgggaggtaggtcgttagaagcgacggcccggttcggggggtcccttaggacgtacccttccgttccgtggtcgtccgacgtccgttcgttcgggtacctaccggtacgaagtacgacctaacgtaacngtagacgtcggtcggcccgacgacggccgtacgggaggggacggggcggtaggtcgggtactcgtttagttacgttagtggtacggtaacaaactacgtaactacgtacagacgtacgtccggaggaacggccgtactcaaccgtctacgtaccgacgtaacgacctaagtaacgaaaacgtacctattaacgtttccgtaacttcgttaaaccgtaaagtaaccgaaacgttaccgccgtaaggccggtaaaccgccgggtaaaaccggccggtaacggttacccgttaagttaccgtttagcgggtacggtaacgaaggttccgggaacttaagggtacggttcgtagttacccgtgtaaccgttgtacgtacggtgggacccggcgtacccggttaccg

SEQ ID NO: 199982 - DNA, 848 bp, Homo sapiens
  misc_feature: GYAE6OF01BRS7T.42.70.G04.1.454.CMB.1.raw
  modified_base (318)..(318): a, c, t, g, unknown or other
  misc_feature (318)..(318): n is a, c, g, or t
  modified_base (342)..(342): a, c, t, g, unknown or other
  misc_feature (342)..(342): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcgttgggtttttccttgttgtctttaattttaaaaagggtgtccagtgtgtaggtgcaggctgggtggagtcgtgggaggaggcttgaagcaggtccgtcggggggtccctggagacctctccgtgtcgcagtccttcgtggttccaccgtcgtagtacgactaacgtanacgttgacgtcggtcgggtacccnccgacggtccgtacggaagggggtaacggggccggtaggtcgggtctcgttagttacttaggtggtacggtaagtaaactacgtactaaccgtacgacgtaacgtacccgttcgggtacggaacggggaccgtactttaccccaaccgttaccgttaccttacccggaaggtaaccgtaaccccgttaaaggtttacccggaaaacctaaccgtaaaccgttcggttttaataccccctttacgtttaaaccgtaaaggttaacccaaaccgggtacgttccccgtaagggaaacgggttacccgggaacccggaaccggggaaccgtaacccggggttaccgtttaacgggtttacttaaccgggtcggttaacgggcgggttaacgggtaccgttacgggtaaccgggtaagtttcggggtacccttaagggtttctaaccggtttacgttcggttaaccccggtaagggtcccggggtaccccgtagggggttaaaccccccg

SEQ ID NO: 199983 - DNA, 858 bp, Homo sapiens
  misc_feature: GYAE6OF01CVOUE.42.70.G04.1.454.CMB.1.raw
  modified_base (723)..(723): a, c, t, g, unknown or other
  misc_feature (723)..(723): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgtcttattttaaaaggtgtccagtgtgaggtgcagcgtggtggagtcgtgggaggaggcttgaagcgacggccggtcggggggtccctgacgtactcctcctgtcgcgacgtcctcgttcgggttccaccgtcaaggtacgacctaaactacagtagacgtcggtccggggtcccgccgacggccgtaccgggaagggggtaaccgggggccggtagggttacgggtcctacgtttagttttaagtttacggtcggggtaccggtaacgtaaaaccttacgtaacgttaaccgtaccggacgtaacggtacccgttaccgggaacggtaaccggggtacccgtaacgttacccgaacccgtacttacccgtaccgaaacggtacccgtaacccttaaacggtttaacccggaaaacgtaaacccttaacgtttaacgtttccggttaaccctttccgttaaactaaacgttaaccgaaccgtacggtacccgtaggaaccgggacggaacccgggaacggtaccccggaaccgggttccgttaagtttaccgtttaccgnggttacggaccgggtaaagtccgggtaccgtaaacgggtaacggttcggttaaccgtttacggttcgtaccgtttagtttacccggtaaccggttccggggtacccggggtaacccgtaaccggggttacccccg

SEQ ID NO: 199984 - DNA, 838 bp, Homo sapiens
  misc_feature: GYAE6OF01CN5SO.42.70.G04.1.454.CMB.1.raw
tcagtgacgtatgtcacgaccggtgctcgatttagtgtagtgtgaagggaaggggggagaggagcccagcactgggattccgaggtgtttccattcggtgatcagcactgaacacagaggactcaccatggagttttggctgagcgttgggttttccttgttgtcttattttaaaaggtgtccagtgtgaggtgcagcgtggtggagtcgtggaggaggtcgtagagcgaggccgtgggggtccctgacgtctctccgtgtcgcgtacgtccgtcgtcgggttcctaaccgtcgagtacgactaaccttagataggacgtccggttcggggtccccgaccggacgggtccgtacccgggaagggggaaccgggacccgggtagggttcgggttccttacggtaggttttaagtttacgggtcggtaccgggtaacgtaaacctaacgtacgttaaccggtacgacgtaacggtacccgtaccggttacgggaaacgggttacccgtagtttaaccccggtactaccggtacctacccggaacgtaaccgtaccgtacgttaacggaaactaaacctaaccttaagttaccgttacctttaacgttaaacgtaaacgtaacgaaaccgtacccgtaccgtaaggaccggaacgggtacccggaacgggtaacccggtaaccggtacccgggttaattaacgttcccggttaggtacgggtacgaaagggttccggttaacgtacgggtaaaacggttggtaaccgtttacggtacggttaaccttaggtttaccgtacggttaccgggttacgggacccggttaaccgggttaccccgg

SEQ ID NO: 199985 - DNA, 631 bp, Homo sapiens
  misc_feature: GYAE6OF01AS8BZ.42.70.G04.1.454.CMB.1.raw
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (540)..(540): a, c, t, g, unknown or other
  misc_feature (540)..(540): n is a, c, g, or t
  modified_base (560)..(560): a, c, t, g, unknown or other
  misc_feature (560)..(560): n is a, c, g, or t
tcagtgacgtatgtcacgaccggtgctcgatttagtgtagtgtgaagggaaaggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtgagtctggaggaggcttgaagcagccgtgggggtcctgagactctcctgtgcagtcctctggttccaccgtcagtagcaactacagtgagcgtcggtccgccgaggcctaccggaggggaacgggggccggaggttcgggtctcgtagtttaatttgtgggtccggtaagaaaaccgttaccaagttaacctacggtacgaagtacccgttccggtaaggaaccggggtaccgtatttacccgaaccctaagttcctaccgaagacgtaacccagtttacgaaacgtaacacttacttgtacttcttacaatacgaanacgcgngagacgccggagaccncggtcctagtattacgtagngacgagcggtatacggtaaggtcgacgttcgtcgacttagttcgacttaggtcgggccgtacgggtacccg

SEQ ID NO: 199986 - DNA, 687 bp, Homo sapiens
  misc_feature: GYAE6OF01CM5ZD.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaaggtgtccagtgtgaggtgcagctggtggagtctggaggaggcttgaagcagccgtggggggtccctgagactctcctgtgcagcctgtgggttcaccgtcagtagcaactacatgagcgtcggggtcccgccgacggcctaccgagggggaacggggccggaggtgggtctcgtagttaatttagtggcggtagaaacgtacaatacgtacgcaacgactccgtagaacgggccgattcaacccatcctaccgaagaacgaacccaattaccgaaaacgaaaccactaagtttcgtaccttaccttaacaaaatcgaaacctacggaccccgtaggaacgaacggtcccggaaagggaacccaccggggtccgttaaggttaactttaaccgtgggtacgaccggtaaggtacgggttaccgtaaacggtaaaagggtcgggtaccttaagggttcgaccttaagtttcgaacgttaaccggcgggggaacccgaacgggggtaaacccccg

SEQ ID NO: 199987 - DNA, 872 bp, Homo sapiens
  misc_feature: GYAE6OF01A0EVT.42.70.G04.1.454.CMB.1.raw
  modified_base (647)..(647): a, c, t, g, unknown or other
  misc_feature (647)..(647): n is a, c, g, or t
tcagtgacgtatgtcacgaccggtgctcgatttagtgtagtgtgaagggaaagggggggagaggagcccagcactgggagttccgaggtgtttccattcggtgatcagcactgaacacagaggacctcaccagtggtagttttggctggagtcgtttcggggtttttcctttggtttcgtactttaagtttttaaaaagggtgtccgaggttgtggagggtgcgaggcgttggggtggaggtcgtgggagggaggtcttaggaagcgacggtccgggttcgggggggtacccctggacgtaccttcccgtccgttaggtcgcctacgtcccgttcggttcggggttcccaacccggttacgaaggtacgacctaaaccgtacgtacgttaggacggtccggtcgggggtaccccggccgtacggggtcccgtaaccggggaaggggggaaccggggggtccgggtaggggttcgggttccttacgtaaggttttacgtttacggtacgggtacggtaacgtaaacttacgtaactacgtacgtacgacggtaccggtaccggtaggaaccgggtcctaacgttaccacccgtaacttcccgaacgtacgaacgtaacccttagtaacggaaacctaacctaacgttnttccgtacttaacgtaactaaagtacaacccggtcacggtaagaacgaccggtaccggaaacggtccggtaaccgggttcgtttaagttaccttagggtacggtcgggaaaccggtagggttccggtaacgttaacggaaagggttccggtaccgttagttacggcttttagggttaccggacccgttaagggggccggggtaccccgtacccgggggtaacccg

SEQ ID NO: 199988 - DNA, 796 bp, Homo sapiens
  misc_feature: GYAE6OF01E0PCG.42.70.G04.1.454.CMB.1.raw
  modified_base (549)..(549): a, c, t, g, unknown or other
  misc_feature (549)..(549): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcgttgggtttttccttgttgtacttaattttaaaaggtgtccagtgtgaggtgcagcgtggtggagtcgtgggaggaggcttagaagcgacggccggtcggggggtccctggacgtaccttcctcctgtcgcacgtcctcgttcggttccaccgtcgagtacgactaactacagtggacgtccgtacggggtccccgccgacggccgtaccgggacgggggaacgggggtccgggtaggtcgggtacttagtagtttagttgtagggacgtagaaactactatacacgacacgtaccgtcggtaggacggtacgtacttaccacctactcctacgaacgactaacctagtacgaaacgtaacctattacgtttctaaccttacttaacaaagtccgaaacncggtaacgtagggaaccgtacggaacccgggtaagggtaccccgtaaccggggtttaccggttagtttaaaccgttttacgggcgggtttaacggacccgggggttaaagttaaccccgggttacgtaaaaaccggggtaacgggtttgtaaccccggttttacggtactaaccgggtttttacgtaaacccggtacgggtttaaccggggacccggggggtaccctaaaacccccggggttacggg

SEQ ID NO: 199989 - DNA, 597 bp, Homo sapiens
  misc_feature: GYAE6OF01B1JWE.42.70.G04.1.454.CMB.1.raw
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (422)..(422): a, c, t, g, unknown or other
  misc_feature (422)..(422): n is a, c, g, or t
  modified_base (451)..(451): a, c, t, g, unknown or other
  misc_feature (451)..(451): n is a, c, g, or t
  modified_base (497)..(497): a, c, t, g, unknown or other
  misc_feature (497)..(497): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctgggtggagtctgggaggaggcttgaagcagccgtggggggtccctgagactctcctgtgcagcctcgtgggttcaccgtcagtagaccaactacatgagcgtcgggtcccgcgaggcctaccggaggggaacggggccggaggtcgggtctcgtagttattagtggcggtanaactacatacacgcagctcgngacggcatcacatcncagacacctatacgaanaacactattgtcttactacaaatcgaacncgcctgacgacggccgaaggacgtaccgggtcttagttacttacgnggtcgacggtaggcggttaccgtaaggtaaacggttcggacgttacggtttgacttagtttacgaccgttacgggcggggacccgtacggggtaaccccg

SEQ ID NO: 199990 - DNA, 594 bp, Homo sapiens
  misc_feature: GYAE6OF01C2CBE.42.70.G04.1.454.CMB.1.raw
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctcgtagggttcaccgtcgacgttagcaactacatgagctgggtcccnccgaggcctcccgaggggaacggggcccggaggtcgggtctacgtagtttatttagngggcggtagaaacctacatactacgcagactcgtagaacgggccgtattcacctatcctacgaagacgacctattacgaaagaaccacgtattgtcctactacaaactcgaacagccctaggacgacgaccgaaggaccgacggtccgtgtaacttcgtgtcgacgagacggtctacggaaagtcggactcggtgactagttcgacctaggtcggggcgtacgggtaacccg

SEQ ID NO: 199991 - DNA, 839 bp, Homo sapiens
  misc_feature: GYAE6OF01D3T1H.42.70.G04.1.454.CMB.1.raw
tcagtgacgtatgtcacgaccggtgctcgatttagtgtagtgtgaagggaaaggggggagaggagcccagcacgtgggattccgaggtgtttccattcggtgatcagcactgaacacagaggactcaccagtggtagttttgctgagtcgttggttttccttgttgtacttaagttttaaaaggtcgtcctagtgtgaggtgcgagcgtggtgagtcgtaggaggaggtcttaggaacgcgacggtcccggttcgggggttccctaggacgtaccttcccgttccgtgtcgaccgtacgtccccgttcggtttaccggttccctaacccggtaacgtaacggtaaccgtaacccgtaaaacctaccgtaagtacggacggtccggttccgggtaccccgaccggtaccggtcccggtaacccggggaagggggaaccggggtccgggtacggtttcgggttacccttagtttaaggttttacgtttacggtacgggtaccggttaacgtaaaccgttaacgtaacgttaaccgtaaccgtacgaaccgtaccgtaccggtaacggtaacggtaccgtactacctaacccgtactaccgaccgtaacgaaccgttaactaacgtacggaaaacctaactacgttaactttgtacccttaagttaaccaaagtaccgtaacacgcgtaacggacggtaacgacccggagtaacccggcgttcgttaattacgttgcggagaaccgtaggtaccgtaaccgtaagggtaagttccgtaacgtttcggacgtacttaaggttccgaaaacccgttcggggaccggtaccgtcccggtaacccg

SEQ ID NO: 199992 - DNA, 798 bp, Homo sapiens
  misc_feature: GYAE6OF01D7Z8F.42.70.G04.1.454.CMB.1.raw
  modified_base (603)..(603): a, c, t, g, unknown or other
  misc_feature (603)..(603): n is a, c, g, or t
  modified_base (675)..(675): a, c, t, g, unknown or other
  misc_feature (675)..(675): n is a, c, g, or t
  modified_base (744)..(744): a, c, t, g, unknown or other
  misc_feature (744)..(744): n is a, c, g, or t
tcagtgacgtatgtcacgaccggtgctcgatttagtgtagtgtgaaggggaaagggggggagaggagcccagcacgtgggatttccggaggtgtttccatttcggtgatcagcactagaacacagacggactccaccagtggtagttttggctgagtcgtttcggttttccttgttgtactttaagttttaaaaggtcgtccgtagtggtggtaggtgcgtagtcggtgggtggtaggtcgtagggaggtaggtcgtagaacgcgacggtcccggggtcggggtcctagactctcctcgtcgtcgaccgtcgtcccgttcggtccggtaccgacgttacgaagtacgaacctaatacgtgtaggtacgtccggttaccggggccccgtaacggacccgggttccgggaaccgggggaacgggggggtaccggggtccgggttaaggtttcggttacttagtttaggtttacgtttaggtcgggtaacgtaaactaactactaagttaaccacggaccgacgtaccgtacggtaaggccggtactactaccatccgtacctacgggactaacgtaacctagaacctaaacacgtacttacgttnttaacccgtttacctaaagaaacgttgaaccctacgaggttagaaccggtacgaccgggttaagacccgggntttacgtacgttacgtaggcggtaggaaccggttaggtacccggtaatacgggtcggttctaagggttnaacgtacgttcggtaccgttagacggggtccgtacgggtcccgttaaacccggg

SEQ ID NO: 199993 - DNA, 168 bp, Homo sapiens
  misc_feature: GYAE6OF01BF8KW.42.70.G04.1.454.CMB.1.raw
  modified_base (167)..(168): a, c, t, g, unknown or other
  misc_feature (167)..(168): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcgggctggcaaggcgcatagnn

SEQ ID NO: 199994 - DNA, 590 bp, Homo sapiens
  misc_feature: GYAE6OF01E5D7T.42.70.G04.1.454.CMB.1.raw
  modified_base (428)..(428): a, c, t, g, unknown or other
  misc_feature (428)..(428): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggtcaccgtcagtagcaactacatgagcgtgggtcccgccaggctccgaggggacggggccggaggtcgggtctcgtagtttatttagtggcggtagaaactacatactacgcagactccgtagaacgggccattcacctatcctaccagacgaccattacgaanaacactattgtctcttacaaatgaacagcctagagacgccgaaggaccgacggtccgtagtacttacgtgtggcgagtacggtacgtacgaaaggtcggaccttacggttcgtactagtttacgaccgttacgggtcgggggtcccgaacgggggtaccccg

SEQ ID NO: 199995 - DNA, 815 bp, Homo sapiens
  misc_feature: GYAE6OF01B0TU8.42.70.G04.1.454.CMB.1.raw
tcagtgacgtatgtcacgaccggtgctcgatttagtgtagtgtgaaggggaaagggggggagaggagcccagcactgggattccgaggtgtttccattcggtgatcagcactgaacacagaggactcaccatggtagtttgctgagtcgttgggttttccttgttgtacttaagttttaaaaggtgtccgagttgtggaggtgcgagtcgtgggtaggagtcgtgggaggaggtcgttagaagcgacggtccgggttcgggggtcctaggacgtaccttccttccgtgtcgaccgtcgtccttcggttcggttaccaccggttacaacgtacgacctaactacagtcgacggtcggtaccggggtccgaccggacggtccggtacgggaagggggaccggggtcggtaggtcggtacgttagttagtttagtttacggcggtacggtaataaacctacgtaactaccgtacgcgtaacgtaccggttacggtaacggtaacgggcctacttaaccaccgtacttaccgaccgaacgtacgtaaccttacgtaaacgaaactaactacgttacgttacgtacctttaacgtaacgtaaacgtacgaaccgtcgtaccgtaggaaccgtacggaaccggtaaccggaccggtacggttaaccggtttaagttaccgtttagggtacggacggtacggtaagggtaccgttacgggttaaacggtaacggttgttaacccggttaggttccgaacgttttacggttaccggaaccggtttacggggaccggggtaacccggaaccgggtttaccccgg

SEQ ID NO: 199996 - DNA, 860 bp, Homo sapiens
  misc_feature: GYAE6OF01D11SZ.42.70.G04.1.454.CMB.1.raw
  modified_base (186)..(186): a, c, t, g, unknown or other
  misc_feature (186)..(186): n is a, c, g, or t
  modified_base (800)..(800): a, c, t, g, unknown or other
  misc_feature (800)..(800): n is a, c, g, or t
tcagtgacgtatgtcacgaccggtgctcgatttagtgtagtgtgaagggaaaggggggagaggagcccagcactgggattccgaggttgtttccattcggtgatcagcactgaacacagaggactcaccatggtagttttgctgagtcgttgggttttccttgttgtctttaatttttaaaaggtntccagtgtgaggtgcagtcgtggtggtagttcgtggaggtaggtcgttagaacgccgacggtccggtcgggggtccctaggacgtaccttcctccgttagtcgacgtcgtccgttacgtttcgggttcctaaccggtcgtaagttaacgacctaaactacgtaagtcggtacggtccggttccggggtaccccgaccgtacgggtcccgtaaccgggaaggggggtaaccgggggtccggtaagggtttccgggtacttacgtttaggtttaacttttacgggtacgggtacgtaacgtaaaccttacgtaacgttaccgtacgacgaacgtcccggtacggtaacggaacggtcccgtaacttaccaaccctagttacccgtacgaaggtaaccctaccggtaacgttaacgaaaacgtaacgtacttacggtttacgttacccttaacgttaaacaaacgttacgaacccttgaccggtaagaaaccggtcggaaacccgtaaggggaccccttacggggtaccgttttaggttaaaccttacgggtcgtacgacggtaaacggtcggtttaacccgtaagggtaacgggtggttccgtttaagggttaccnggtttaccgtttacggaaaccgtttccggggacgggtaaccccgaacgggtttacccccg

SEQ ID NO: 199997 - DNA, 963 bp, Homo sapiens
  misc_feature: GYAE6OF01BCHPF.42.70.G04.1.454.CMB.1.raw
  modified_base (195)..(195): a, c, t, g, unknown or other
  misc_feature (195)..(195): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagcttgggttttccttgttgcttattttaaaaggtgtccagtgtgaggtncagctgggtggagtcgtgggaggagtcgttgaagcaggccggtcggggggtccctggaacgcttccgtcctgtgcctacgccgttcggttcggttaccaccggtacgtacggttaacgactaaaccttacgagtacggtacggtccggtccgggggtccccggccggtaccggggtcccggttacccgggggaacgggggggtaccggggggtacccggggttaaggggttccgggggttaccgtttaccgggtttaaaggtttttaacgttttacggggtacggggtaaccggggtttaaaccgtaaaacccgtttaaacgtacgtttaaaacccggttacccgaaccggtaaccggtaaccccggttcccgggtaaggggtaacccgggggtacccgtacgttaaccctaacccgtaccgttacccgttaacccgaacggaaccgtaaccgtaaaccgttaacggaaaacccgtaactaacccgttacgttttaccgttacctttaacctttaaacaaacggtttaccgaaaccgtaccggtacccgttaaggaaccggaaccgggaaccggaaccgggtacccggtaccggggttccgttaaacggtttactccgggttagtaccgggttacggaacgggtttaccggtaaccgttacgggaaaggttacccgggttactttcggtaacgttcccgtttaaggtttccggtaaccgggtttacccggggtaccggggtaaccccggttaaaggggttaccccccg

SEQ ID NO: 199998 - DNA, 731 bp, Homo sapiens
  misc_feature: GYAE6OF01C1KKW.42.70.G04.1.454.CMB.1.raw
  modified_base (264)..(264): a, c, t, g, unknown or other
  misc_feature (264)..(264): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtcgtggaggaggcttgaagcgaggtccgtcgggggtccctgacgacctctcctgtcgacngcctcgtcggttcaccgtcagtacgacaactacagtgagcgtcgggtccgcgaggccgtacggaggggacggggccgtaggtcggtctagtagttactttaggtggtcggtacgaaacctacgtaactaccgtacgacctagtaccgtaccggtaggaaacggggtcccgtaagttaccacctaacttccctaccgaacggaaccgtacctaacgttaaccgaaacgtaaaccctaacgtatttccgttacttaccgtttaaactaaagttacgaaaccgtacgtcccggtagacgggtaacggcccgggaacggaccgtccgggtaacgttacggttaacgtttaccgtggtcggtacggtaggacgtttacggacggttaaaggtttcggtaacccgttaggtttacgacttacgtttacggtaccgtttaaccgggcgggggtacccgtaaccgggtaacccgg

SEQ ID NO: 199999 - DNA, 787 bp, Homo sapiens
  misc_feature: GYAE6OF01BF6LN.42.70.G04.1.454.CMB.1.raw
  modified_base (564)..(564): a, c, t, g, unknown or other
  misc_feature (564)..(564): n is a, c, g, or t
tcagtgacgtatgtcacgaccggtgctcgatttagtgtagtgtgaagggaaaggggggagaggagcccagcactgggattccgaggtgtttccattcggtgatcagcactgaacacagaggactcaccatggagttttggctgagtcgttgggttttccttgttgtacttattttaaaaggtgtccgagtgtgaggtgcgagcgtggtggagtcgtggaggaggtcgttagaagcgacggtccggttcgggggtccctaggacgtaccttccgttcccgtgtcgcgacgtccgttcgtcggttccgacccgttcgacgtacgactaacgtactagtcgacgtccggtcgggtcccgcgacggccgtccgggaaggggacggggtccggtaggtcgggtaccttagtagtttagttacggtacggtacgtaacgtaacgtacctaacgtaaccgtacgacctaacggtaccgtcggtaacggaaccgggtaccgtacgttaccgaaccgtactaccgtaccgaagaacctacctaacggttaaccgaaacgtaactaaccggttntttaccggtacttaccgttaacaaaacgtacgaaccctaggtcccgtaaggacggaaccggaccggaagacccggtaccggtcgttaagttacgtaccgtaggtcggaacggtacggtaccggttaacggtaacggtaaggtccggttaaccgttaggtacgttacgtaaacgtttcgtaacccgggtacggtacccggggtaccgtaacggggttaaccccg

SEQ ID NO: 200000 - DNA, 661 bp, Homo sapiens
  misc_feature: GYAE6OF01BYQ3J.42.70.G04.1.454.CMB.1.raw
  modified_base (317)..(317): a, c, t, g, unknown or other
  misc_feature (317)..(317): n is a, c, g, or t
  modified_base (377)..(377): a, c, t, g, unknown or other
  misc_feature (377)..(377): n is a, c, g, or t
tcagtgacgtatgtcacgaccggtgctcgatttagtgtagtgtgaagggaaagggggggagaggagcccagcactgggattcccgaggtgtttccattcggtgatcagcactgaacacagaggactcaccatcggagttttggctgagctgggttttccttgttgctattttaaaaggtgtccagtgtgaggtgcagctggtggagtctggaggaggcttagaacgcgaggccgtgggggtccctgagactctctgtcgcagcctcgtggttccaccggtcgagtagaccaactacgatggagtccgttacgggccnccgacgggtctaccggaggggaacgggggccggtaggtcgggtctcgtagtttatttagnggtacggtagaaactacactacgtacgcacgtacgtcgtaggtaacgggtccgtattcgaacctatccgtaccgagtacgacctagttacaaacgaacctactacttgtaccttacttacaaacgtcggaaacacgtctaggaacgcggacccggaaggaccgaccgggtaccgtagttaacttacgtacgtgaccggtagcggtaccgtacggtaaacggtggtacctcgggttacgcttacgttacgacgttacggcggggtaccgtaccggggtaaccccg

SEQ ID NO: 200001 - DNA, 721 bp, Homo sapiens
  misc_feature: GYAE6OF01D9XEL.42.70.G04.1.454.CMB.1.raw
  modified_base (144)..(144): a, c, t, g, unknown or other
  misc_feature (144)..(144): n is a, c, g, or t
  modified_base (211)..(211): a, c, t, g, unknown or other
  misc_feature (211)..(211): n is a, c, g, or t
  modified_base (326)..(326): a, c, t, g, unknown or other
  misc_feature (326)..(326): n is a, c, g, or t
  modified_base (533)..(533): a, c, t, g, unknown or other
  misc_feature (533)..(533): n is a, c, g, or t
  modified_base (605)..(605): a, c, t, g, unknown or other
  misc_feature (605)..(605): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcacatggtagttttgctgngtcgttgggttttccttgttgtcttaattttaaaggtgtccagtgtggaggtgcagtcgtggtcggngtcgtgggaggaggtcgtagaacgcgacggtccgggtcgggggtccctagagtaccttcctccgtgtcgcctacgtccgttcggttcggttccaccgtcgtagtacgacaaactnagtaggcgcggtccggtccgcggaccgtccggacggggtacggggacggggtcggtaggtcggtacttacgttgtttaacgttggacggtacggtaacgtaactaactacgttacgtacacgtacggtaccgtcggtaacggacggtaccctataccacctattcccgacgaatacccgtactaagtacgaaactaccatacgtttntaccttagtaacagtacgactacgccgtaaggcgtaccgacggacgaccgtacgttacgtagtccgttaagnggtcgtaacggtacgggtcctaaaggtcggttaaacgttgtacccgtttggtacccttagttacgttttaccgggaacgtttaacccggggcgggacccgttaacgggtaccccgg

SEQ ID NO: 200002 - DNA, 808 bp, Homo sapiens
  misc_feature: GYAE6OF01AD3NF.42.70.G04.1.454.CMB.1.raw
tcagtgacgtatgtcacgaccggtgctcgatttagtgtagtgtgaagggaaagggggagaggagcccagcactggattccgaggtgtttccattcggtgatcagcactgaacacagaggactcaccatggagttttggctgagtcgttgggtttttccttgttgtacttaagtttttaaaaaggtgtccagtgtgaggtgcagcgtggtggagtcgtggaggaggcgttagaagccgacggtccggtcggggggtccctggacgtacctccgtccgtgtcgccacgtccttcgttcgggttaccaccgtacgaacggtacgacctaaactacagtaggacgtccggttacgggtcccgaccgacgggccgtacccggaagggggaacgggggcccgggtaggttcgggttaccttacggttaggttttaagtttacggtcgggtaccggtaagtaaaaccttaacgttaacgttaaccgttaacgaccgtaacggtacccgttaccgggtaggaaaccggggtcccgttaacgtttaccccgaacccttacgtaccctaacccggaagaaccgtaccctaagttaaaccggaaactaaaccttactacgttttcggtaaccttaccgttaaccgaaagttacgaaccacggtacccgtaggaacgacggaccggtaaacgaccggaccggtaccgtttaggttacttcgtggtacggcggtagttaccggtacgttaacggaaggttcggttacgttagtccgtagttagttccgaacgttaccggcgggaccgttaccgggtacccg

SEQ ID NO: 200003 - DNA, 752 bp, Homo sapiens
  misc_feature: GYAE6OF01CYFNT.42.70.G04.1.454.CMB.1.raw
  modified_base (336)..(336): a, c, t, g, unknown or other
  misc_feature (336)..(336): n is a, c, g, or t
  modified_base (482)..(482): a, c, t, g, unknown or other
  misc_feature (482)..(482): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgtacgtcgttggggttttccttgttcgtcttaagttttaaaaggtgtccaggtgtagacggtgcgtagtcgtgggtcggtagtcggtgggaggtacggtcttaggaacgccgacggtccgggttcggggtccctggtaccgtcctctccgtagcgccgtcgtccttacgtcggtccaccgttacgacgtaancgtaacacgtacgtcggacggtccggtccggtcccgaccggtcggtacggtaccggggaacggggtccgggcggtacggtttcggtacgttacgttacggttgttacggtacggtaaccgtaacgtaacgtactacgtaaaccggngtaaccgacgtccggtaccggacggttacgaccctacctacgacgttaccacgtaacgacgtacacgttacgtaactacgtaacttacgtcttacttacctacgtaaacacgtaccgacgtcggtacggacgacgggaacgtccggtaagtcccgtaggttcgtagttcgtcggtacggtacgtggtaacggttccgtagacgggttaccgtgtacggttcgacgttacgacgttaccggcgtacggggaccctgggttcccgtacccgg

SEQ ID NO: 200004 - DNA, 943 bp, Homo sapiens
  misc_feature: GYAE6OF01CNJ70.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagagactcaccagtggtagttttggctggacgtcgtttgggtttttccttgtttcgtactttaaagtttttaaaaaggtcgtacctagtggtgaggtgcagcgtggtggagtcgtggaggaggtcttaggaagcgacgtccggtcgggggtccctgacgtacctccgtccgttggtcgcacggtcccgttcggttacgggttacccgaaccggtacgtaacggtacaacctaaaccttacgagttacggcgtccggtcgggtcccgcgacggtccgtaccgggaacgggggtacggggccggtaggtcggttcgtacgtaggtttaagttgggacggtacggtaagtaaactactaacgtaccgtacgactacggtaccgttacggtaacggtaaccgggtacctacgttacccgaaccttacgtaccgtacccgaaaggtacccgtaaaccgttaaacgttaaacccggaaaacgtaaaacccgttaacttaacggttttaacccgttaacctttaacgttaaacgttaaaacggtaacccgtaaacggtaccgtaacccgggtaagaaaccggggtaccggaacccgggtaaaggggtaaccccgtacccggggttacggtttaagttaaccccgtttaagggttacggaggttaaacccgggtgggttaaaaccccggtttagggtaaaccgggttaaaacgggtttcccgggttaaacccggttttaaaccggttcggttaaaccgttttcgtttaaacccgggtaacggttacccgggggttaaacccgggaacccgggtttaaaccccgggtaccccggg

SEQ ID NO: 200005 - DNA, 601 bp, Homo sapiens
  misc_feature: GYAE6OF01CDUKQ.42.70.G04.1.454.CMB.1.raw
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtgggggtccctgagactctcctgtgcagcctctgggttcacgtcagttagcaactacatgagctgggtccncagggctccgaggggaacggggccggagtcgggtctcgagtttattagnggacggtagaaactacataactagcagactcgagaggcatcacatctcagagacctagtacgaaagaacactaagttgtaccttacttacaaaagttcgaaacgacgccgtaggagaacgccggaaggtacgaccgggtccgtagttacttacgtggacgcgtaaggtacggtctacggaaaagttgggaaccttacggttacgcttaagtttcggaccttaacggcgggggtacccaacggggtaaaccccg

SEQ ID NO: 200006 - DNA, 784 bp, Homo sapiens
  misc_feature: GYAE6OF01EM689.42.70.G04.1.454.CMB.1.raw
  modified_base (172)..(172): a, c, t, g, unknown or other
  misc_feature (172)..(172): n is a, c, g, or t
  modified_base (573)..(573): a, c, t, g, unknown or other
  misc_feature (573)..(573): n is a, c, g, or t
tcagtgacgtatgtcacgaccggtgctcgatttagtgtagtgtgaagggaaaggggggagaggagcccagcactgggattccgaggtgtttccattcggtgatcagcactgaacacagaggactcaccatggtagtttgctgagctggtttccttgttgcttatttaaaggntccagtgtgaggtgcagtcgtggtggagtcgtgggaggacggcttaggaagcgtaggcccggttaggggggtccccttagacgtaccgttccgtccgtgtcggactacgtcccgttcgttcgggttacccaccggtctaagtacgtactaactacctaagttcgacgtccgtacgggtcccgaccgacggtaccgttccggaacggggacgggggtcccggtagggttcgggtccttacgtagtttacgtttacgtcgggtacgtacgaaactacgatacgtacgacgtacggtaccgtcgtaggacggcgtacgtacacgtactcccacgtaacggaccttaacctagtaccggaaaactctaagtacttttcggacctgtttaaaccagtacgtaaacnccggtactacggaggtaccgacgtaacgggaccctcccggtaggtttagtttacctagggttccggacgtacgggtacgttacggttaaccgtaccgggaaagggttttcccgggaccttaacgggggtttctaaacccgtttaacggttttcaaaccggggtttacccgggttaccggggaaccccgttaaccccggggttaaacccggg

SEQ ID NO: 200007 - DNA, 815 bp, Homo sapiens
  misc_feature: GYAE6OF01EPN0J.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagagactcaccatggtagtttggctgagtcgttgggttttccttgttgtacttaagtttaaaaggtgtccagtgtggaggtgcaggcgtgggtggtagtcgtgggagggacggtcgttaggaacgcgacggtcccgggttacggggggtcccttggaacgtccttccgttccgttggtcgtacgtccgtccgttccggttaccgggttcccgtacccgtacgtaacgttaacggacctaaaccttacaacggttcggacgtccggttccggggtcccgaccgtacggggccggttaaccgggaagggggaccgggggtcgggtacggttgggtaccttagtagttttgttagtgggtacgtaacgaactaagactacgtaccgatacgtaccgtcggtaggacgtcgtacttaccgaactcttccaacgacggactaccgtataacgaaacgtactaccttagttccgtactacgtaactaagtacgaactccggtaacgtacggaacgggttaacgaccggtaacgggcccgtaacgggtaccgtttacgttaacgttacgtacggtacggtaaccggtagggtaccgttaaccggtaggttaaacccggtgggtttacccgttaccgttgtactttaccgggttacgtaacgggtttacccgggacgggtaacccgggtacccggttaaccccggg

SEQ ID NO: 200008 - DNA, 1132 bp, Homo sapiens
  misc_feature: GYAE6OF01A4V2K.42.70.G04.1.454.CMB.1.raw
tcagtgacgtatgtcacgaccggtgctcgatttagtgtagtgtgaaggggaaagggggggagaggagcccagcactgggattccgaggtgtttccatttcggtgatcagcactgaacacagaggactcaccatggtagtttggctgagtcttgggttttccttgttgtacttaagttttaaaaggtgtcctagtgtgaggtgcagcgtggtggagtcgtgggaggaggtcgttaggaacgcgtaacggtcccggttcgggggggtccccgtaggacgtaccgttccgtcccgttaggtcggtaccgacgtcccgttccggtttccggggtttacccgtaacccggttaccgtaacggtaccgtaacctaaaccgtaactacgtaggtacggtccggttccggggtccccggccggtacgggtcccgtaccggggaacgggggggaaccggggggtaccggggtacggggttcggggttaccgttaacgtttaaacggtttttaacgttttaacgggttacggggtaccgggtttaaaaccggtaaaaccgtttaaaccgtaaaccgttaaacccgtaaccggtaacccggtaaaccggtaacccggttacccgggtaaacgggggtaaacccggggttacccggttaaaccgttttaacccgaaaccccttaaccgtttaccccggaacccgtaaacggggaaaccccttaaaacccggtaaaccggttaaaccccgggtaaaaacgtaaaaacccgttaaacccgttttaacggttttaccgttttaaccccgttaaaccctttttaaaacggtaaaaaccgtttaaacccggttaaacccgaaacccgggttcccggttaaaacggggaacccgggtaaccggggaaacccccggggaacgggtaacccccggggttaaaccccgggtcccggttttaaacggtttaacgtttaccgggtacgggttaagggtaaaccggggttacgggtaacgggttaaccgggttaaacgggttaaacggggttccgtaaccggttttacggttaccggtacgtttaacgttttacggaaaccccgggttacgggttaccccgggggtaaaccgggttaacccgggggttaacccccg

SEQ ID NO: 200009 - DNA, 808 bp, Homo sapiens
  misc_feature: GYAE6OF01DP0YN.42.70.G04.1.454.CMB.1.raw
  modified_base (696)..(696): a, c, t, g, unknown or other
  misc_feature (696)..(696): n is a, c, g, or t
tcagtgacgtatgtcacgaccggtgctcgatttagtgtagtgtgaaggggaaagggggggagaggagcccagcactgggattccgaggtgtttccattcggtgatcagcactagaacacagacggactcaccatgggtaggttttggctgagtcgtttgggtttttccttgttgtactttaagttttaaaagggtgtccgtagtgtggagggtgcgagtcgtgggtggagtcgtgggaggaggtcgtggaacgcgacggtcccgggtcggggggtccctggacgtaccgtcctccgtggtcgcacgtccttcggtcgtccgtaccgtacgagacgacctaactacagtgacggtccgtcgggtcccgaccggacgggtccgacggggaacgggggtacggggcggtaggtcgggtctagttagttacgttagcgggtacgtaagtaaaccgtactaataaccgtacgacgtacggtaccgtaccggtaacgggaaccgggtccgtactaccccgaacttacctacccgtaaccgaacggtaaccgtaaacccgtaacgtaaacgaaaccgtaacctaaccgttatttcccgtaacctttattaaaacccaagttaaacccggaactcgtaaccggtagaacgggtaccgggaaccgtacgggaacccggttcgggtaccgttagttaccgttaagnggtaccgggtacgaggtaccggtacgttaacggtaacgggttgtacgtttaccgtgtacgttacgttaaacgtcccggacggggttaccgggaccggtaacccgggttccgg

SEQ ID NO: 200010 - DNA, 778 bp, Homo sapiens
  misc_feature: GYAE6OF01AQORY.42.70.G04.1.454.CMB.1.raw
  modified_base (286)..(286): a, c, t, g, unknown or other
  misc_feature (286)..(286): n is a, c, g, or t
  modified_base (708)..(708): a, c, t, g, unknown or other
  misc_feature (708)..(708): n is a, c, g, or t
tcagtgacgtatgtcacgaccggtgctcgatttagtgtagtgtgaaggggaaagggggggagaggagcccagcactgggattccgaggtgtttccattcggtgatcagcactgaacacagaggactcaccatggtagttttggctgagcgttgggttttccttgttgtacttaattttaaaaggtgtccagtgtgaggtgcagctgggtggagtcgtgggaggaggtcttaggaagcacgggtcccggtcgggggggttccctaggaccgtacctcctaccgttgngccagtcccgttcgttacgggttccctaccgtcgaaggtacgtaccaactacgagtcggtacggcggttcgggtccccggaccgacgggtcccgtaccgggaagggggtaacgggggccggtaacgggttgggttacctacgtttaaggtttagttttaggcggggtacgtaacgtaaactacgtaacttaaccgtacgacgtaaccgaccgtttaccgggaaggaacggggtaccctattaccaacctactaccgttaccgaagtaaccgtaccttaacgtacgaaacgtaactacgttaagttccgtataccgtaataaacgacgaacgtacgtccaaggggtaacacgggacccggtaagaaccggtcgggtaccgtttatacgttaacgtgtacggagtcggaggttctaaacgggtntacggtacgttcgtacgacgtttcgttaacggacccgtaggggttcccgggccgtaaacgggtcccccgg

SEQ ID NO: 200011 - DNA, 989 bp, Homo sapiens
  misc_feature: GYAE6OF01A550B.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcaactgaacacagaggactcaccatggtaggttttggctggacgtcgttgggttttccttgttgtacttaagttttaaaagggtgtcagtggtgaggtgcgagtcgtggtggagtcgtgggaggtacggtcgttagaagtcacgggtccggttcggggggtaccctggaacgtaccgttcgtccgtggttcggcctacgtccgttcggtacggttccgaaccggttacgtaggtaacacctaacgttaccgagttacggacgtccggtacgggtacccggacggtacgggtccgtaccggggaacggggggtaaaccgggggtccgggagggttacggggttactttaccggtttaaagggttttacgtttagggtaaccggggtacgttaaacggtaaaacctaacgtaacgttaaaccgtttacggaccgtaacggttacccgttaccgggtacggtaaaccgggggacccttaaacggtttacccaaacccgtaccttacccgtaaccgtaaacggtaacccgtaaccgtaaggtttaaccccgaaaacggttaaacctaaccgttaacggtttaccttaacccgtttaacctttaaacggtaaaacgttaacggtaacccggtaccgttaacccgggtaaggtaacgggaacccgggtccgtaaaccgggggtaacccctaacggggtttacccgtaaggttttaacgtaacgggtaccggttaacggaccgggttaaacgggtaccggttaccgggttaaccgggttaaacggttcccgggttaacggtttaacggtttaccgaacgttttaacgggttaaccggttaaccggtacccggggtacggggtaacccgggtaaccggttaacccccggg

SEQ ID NO: 200012 - DNA, 904 bp, Homo sapiens
  misc_feature: GYAE6OF01EEZWR.42.70.G04.1.454.CMB.1.raw
  modified_base (204)..(204): a, c, t, g, unknown or other
  misc_feature (204)..(204): n is a, c, g, or t
tcagtgacgtatgtcacgaccggtgctcgatttagtgtagtgtgaagggaagggggggagaggagcccagcactgggattccgaggtgtttccattcggtgatcagcactgaacacagaggactcaccatggtagttttggctgaggtcttgggtttttccttgttgcttaattttaaaaggtgtcctagtggtagagtgcagngttggtggagtcgtaggaggtggtcgttaggaagccgtacggtccggtcgggggtcccctagacgtacctcgtccgtgtcgcgtacgccttcggtcggttacgaccgtagagtacgaacgtaacctacagtggacgtccggtacgggttcccgcggtacggcccgtacggggaacgggggtaacgggggtccgggtaggttacgggtccttacggttaaaggtttttgtaaaggtttcggggtaaccggttaacgttaaaaccttaaacgtagttaacccgtaccggacgttaacggtaacccggttacccggtaggggtaaccgggtacccttacggttaccctaacccgtaacgttacccgaacccgtagtaaccggtaaccgttaacgttaaacccgggaaaacttaaacccgtaaaccttcgtttacccgtaaacccttttaccgtaaaaccaaaacggttaaccgtaaacgtaccggtacgtacgggaaacgaccgtaccgggaaccggtacccggtacgggttcccttaacggtttacttacccggtagggtaccggtacgtaacggttacgggtaacgtaaccgggttaaaggtggttacccggttaaagggttcgtaaacgtttacccggttagggttaaacccgttacccggggtaccggggtacccggtaaccggggtttaacccccggg

SEQ ID NO: 200013 - DNA, 954 bp, Homo sapiens
  misc_feature: GYAE6OF01BK1XX.42.70.G04.1.454.CMB.1.raw
tcagtgacgtatgtcacgaccggtgctcgatttagtgtagtgtgaaggggaaagggggggagaggagcccagcactgggattccgaggtgtttccattcggtgatcagcactgaacacagaggactcacctatggtagttttggctgagcgttgggtttttccttgttgtacttaagttttaaaaaggtgtcctagtggtggagggtgcaggcgtgggtggaggttcgtggggaagggaggcttaggaagcgacggtccgggttcggggggtccctaggacgtaccttccgtccgtggtcgccgaccgtccgttccgtttcggggttacctacccgtagtacgtacgacctaaactagagtagcggtcggtaccggggtccccgaccggcggtacccggtaccgggggaacgggggaaccggggggggtacccgggtaggggttttaccgggtctttacggtttaaaggttttttagtttacgggtacggggtaaccgggttaaaacgtaaaaacccgttaacttaacgtttaaccccggaacggtaccgtaacgggtttaaccccggttacgggttaacgggggaaaccccgggggttaccttaaccctttaaccccggaaccttaacccgtaccccgtaaccggtaacggaaacggtttacccctaaacggtttaaaccgggaaaacgttaaacccttaacttcggttttaccgttaaccttaacgttaaacctaaaacgttaacgaaccgtccggtaacggtaacggtacgggaaccgggtacccggaaccgggtacccgtaccggggttacgtttaaggtttacgtcggtacggtagggaaccggtaggtacgggtacgaagggttaacgggtggttaccgttaggttccgtaagtttacggtttaacgcggtttaccgggcgggggtaaccccgtggggttaaccccgg

SEQ ID NO: 200014 - DNA, 785 bp, Homo sapiens
  misc_feature: GYAE6OF01ECFNH.42.70.G04.1.454.CMB.1.raw
  modified_base (203)..(203): a, c, t, g, unknown or other
  misc_feature (203)..(203): n is a, c, g, or t
  modified_base (371)..(371): a, c, t, g, unknown or other
  misc_feature (371)..(371): n is a, c, g, or t
  modified_base (484)..(484): a, c, t, g, unknown or other
  misc_feature (484)..(484): n is a, c, g, or t
tcagtgacgtatgtcacgaccggtgctcgatttagtgtagtgtgaagggaaagggggggagaggacgcccagcacgtgggattccgaggtgtttccattcggtgatcagcactgaacacagaggactcaccatggtagtttgctgagtcgttggttttccttgttgtacttaagttttaaaggtcgtacgaggtgtgtaggtncgagtgtggtggagtgtagggaggtaggtcttagaacgcgtacggtcccgggttcgggggtccctggaacgtccttccgtccgtgtcggctaccgtccgtcggttcggtacctaccgtacgaagttaccgaacctaactacgtagtagacgttcggtccgggtacccncggtacggtccggaccggggaagggggtaccggggaccgggtaggttccgggtaccttaggttaggtttacgttacggtacggtacgtaacgaaacgtacaacggttaacganacgacgtacgtaccggaggaacggcttactaccgaactcgttacacgaacgacgtacctaagttacgaaactacctacgttattacgccttacgtaagtaacgtacgtacctacggactacggaccggaccgaacgggaccgaaccggttaccgtaccgttaagttacgtacgttaggacgttaggtaacggttcgtaacggttaacccgggtaggttccggttaccggtcgttaaccgttcggtttaagtacccggttacggtaaccgggggtccgtaaccggggtaccgggtaaccccc

SEQ ID NO: 200015 - DNA, 732 bp, Homo sapiens
  misc_feature: GYAE6OF01EFK4M.42.70.G04.1.454.CMB.1.raw
  modified_base (261)..(261): a, c, t, g, unknown or other
  misc_feature (261)..(261): n is a, c, g, or t
  modified_base (322)..(322): a, c, t, g, unknown or other
  misc_feature (322)..(322): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggtttttccttgttgcttaattttaaaaggtgtccagtgtgaggtgcagctgggtggagtctggaggaggcttgaagcgagccggtcgggggtccctgagactctccgtgngcacgccttcgtggttccaccgtcagtacgaccaactacatgacgcgtcgggtcccgccgnggccgtaccgggaagggggacggggccggaggttcgggtcttacgtagtttatttagtgggtacggtaacgaaactacaagttaaccgaacgacgaacgtaccgttaccggtaacggtaacgggacctacgttaccaacccgtacttacccgtaccaaggaaccgacctaagttaaccgaaacgtaaactacgtaactttcgtacctttacctaagttaaacgacgaaaccaccggcttaagggacacgggaacccggtacggaaccggtaccgggtaccgttactttaacgttaccggtaggtacgaaccggtagttaccgggtacgtaaccggtaaaggtcgtacccgttaaggtcgtaacttacgtttacgaacttaccgggacgggtcccggtaccgggtaccccg

SEQ ID NO: 200016 - DNA, 533 bp, Homo sapiens
  misc_feature: GYAE6OF02GH8LS.42.70.G04.1.454.CMB.1.raw
  modified_base (501)..(501): a, c, t, g, unknown or other
  misc_feature (501)..(501): n is a, c, g, or t
tcagtgacgtatgtcacgaccggtgctcgatttagtgtagtgtgaagggaaaggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccgccaggctccagggaaggggccggagtgggtctcagttatttatggcggtgaaactacatactacgcagactccgtgaagggccgattcaccatctccagagaccattcgaagaacacattgtctcttcaaatgaacagcctgagagccgaggacacggccgtgtattactgtgcgagaggtctcggaaagtggactacgttgngtatttgactacgtggggccagggtaaccccg

SEQ ID NO: 200017 - DNA, 549 bp, Homo sapiens
  misc_feature: GYAE6OF02GQ2UY.42.70.G04.1.454.CMB.1.raw
  modified_base (345)..(345): a, c, t, g, unknown or other
  misc_feature (345)..(345): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccgccaggctccgaggggaacggggccggagtgggtctcagttatttanggcggtagaaactacatactacgcagactccgtgaacgggccgattcaccatctccagagaccattcgaagacacattgtctcttacaaatgaacagcctagagacgccgaggacgacggccgtgtacttactgtcgcgagaggtctacggaagtggacttacgttgactagtttgacttacggtcggggaccagggtaacccg

SEQ ID NO: 200018 - DNA, 620 bp, Homo sapiens
  misc_feature: GYAE6OF02F34U0.42.70.G04.1.454.CMB.1.raw
  modified_base (294)..(294): a, c, t, g, unknown or other
  misc_feature (294)..(294): n is a, c, g, or t
  modified_base (347)..(347): a, c, t, g, unknown or other
  misc_feature (347)..(347): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcgtggtttcgtgtagctatttaaagtgtcagtgtgaggtgcagctggtggagtctggaggaggcttgaagcagcctggggggtccctgagactctcctgtgcagcctctgggttcaccgtcagtagcaactacatgagctggggtccnccagggcctccgaggggaacggggccggaggtcgggtctcgagtttatttagnggcggtgaaactacatactacgcaagtactccgtagaagggccgtattccaccatctccgagtacgaccctagttaccgaaagaaacctatacttggtacccttacttacgaaaattcgaaacagtcccgtagacgacggaccgaagggtaccgaccgggtcggttagttaacttaccgtggtacgacggaggtacgtcgtaacggaaggtcggtactacggtttcgacgtagttttcgaaccgtttcgtccgggggacctacggggtaaccc

SEQ ID NO: 200019 - DNA, 572 bp, Homo sapiens
  misc_feature: GYAE6OF02F72FU.42.70.G04.1.454.CMB.1.raw
  modified_base (301)..(301): a, c, t, g, unknown or other
  misc_feature (301)..(301): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (503)..(503): a, c, t, g, unknown or other
  misc_feature (503)..(503): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggttcaccgtcagtagcaactacatgagctgggtcccncaggctccgaggggaaggggccggaggtgggtctcgtagtttatttagtgggcggtagaaactacatactacgcaagacctccggtaggaacgggccgtaattccaacctatcctaccgaagacgacctattcggaaagaaccactattcgcttacttanaaatgaacngcctgagacgccgaggacacggcgtagtattcngtgacgagcgtctacgtaattggcttacgttgactatttcgacttacggcggggtaccacgggtacccg

SEQ ID NO: 200020 - DNA, 554 bp, Homo sapiens
  misc_feature: GYAE6OF02IF9YT.42.70.G04.1.454.CMB.1.raw
  modified_base (346)..(346): a, c, t, g, unknown or other
  misc_feature (346)..(346): n is a, c, g, or t
  modified_base (397)..(397): a, c, t, g, unknown or other
  misc_feature (397)..(397): n is a, c, g, or t
  modified_base (420)..(420): a, c, t, g, unknown or other
  misc_feature (420)..(420): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccgccaggctccgaggggaaggggccggagtgggtctcgagttatttanggcggtagaaactacatactacgcagactcgtgaagggccattcaccatcnccagacgaccattcgaagaacanattgtcttcttacaaatgaacagcctagagagccgagggaccacggccgttagtacttacgtggtgcgagaggtctaggaaagtggcttacggttgactagtttcgacttacggtggggcccagggtaaccccg

SEQ ID NO: 200021 - DNA, 527 bp, Homo sapiens
  misc_feature: GYAE6OF02F70ZM.42.70.G04.1.454.CMB.1.raw
  modified_base (339)..(339): a, c, t, g, unknown or other
  misc_feature (339)..(339): n is a, c, g, or t
  modified_base (472)..(472): a, c, t, g, unknown or other
  misc_feature (472)..(472): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctggtccgccaggctccagggaagggccggagtgggtctcagttattanggcgtgaaactacatactacgcagactcgtgaaggccgattcaccatctcagacgaccattcgaagaacacattgtctacttcaaatgaacagcctagagagccgaggacacggcgtgtattactgtgcgagngtctcgaaaggtgactacgttgacgtatttgacttacgtggggccagggtacccg

SEQ ID NO: 200022 - DNA, 550 bp, Homo sapiens
  misc_feature: GYAE6OF02GTSEC.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggagggaggcttgaagcagccgtggggggtccctgagactctcctgtgcagcctctgggttcaccgtcagtagcaactacatgagctgggtccgccaggcctccgaggggaaggggccggagtgggtctcgagttattatggcggtgaaactacatactacgcagactccgtgaacgggccgattcaccatctccagacgaccattcgaagaacacattgtctcttacaaatgaacagcctgagacgccgaggaccacggccgtgtacttacgtgtgcgaggacggtcacggaaggtggactacgttgctatttcgacttacgtggggcccagggtaaccccg

SEQ ID NO: 200023 - DNA, 610 bp, Homo sapiens
  misc_feature: GYAE6OF02IAKPV.42.70.G04.1.454.CMB.1.raw
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctcgtgggttcaccgtcagtagcaactacatgagctgggtccgccaggcctccgagggggaaggggccggaggtcgggtctcgtagttatttagtggcggtagaaactacatactacgcagactccgtagaacgggcctattcaccatcctaccagacgaccattacgaaagaacacattcgtctcttacaaatgaaacagcctagaacgacgaccggaaggaccacgggccgttagttaacttacgtggtagcgagtacgggtcctaacggaaaggttcgggaccttaacggttgaccgttaagttttcggaacctttacgggtcgggggtaccccaaggggtaaccccg

SEQ ID NO: 200024 - DNA, 536 bp, Homo sapiens
  misc_feature: GYAE6OF02GLGF8.42.70.G04.1.454.CMB.1.raw
  modified_base (348)..(348): a, c, t, g, unknown or other
  misc_feature (348)..(348): n is a, c, g, or t
  modified_base (412)..(412): a, c, t, g, unknown or other
  misc_feature (412)..(412): n is a, c, g, or t
  modified_base (482)..(482): a, c, t, g, unknown or other
  misc_feature (482)..(482): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtcccgccaggctccgaggggaacggggccggaggtgggtctcagtttatttanggcggtagaaactacatactacgcagactcgtgaacgggcatcacatctcagacacattcgaanaacacattgtctcttacaaatgaacagcctgagagccgaggacacggccgtagtacttacgtgtgcgagnggtctaggaaagtggactacgtgctattcgactacgtggggaccagggtacccg

SEQ ID NO: 200025 - DNA, 538 bp, Homo sapiens
  misc_feature: GYAE6OF02GA21K.42.70.G04.1.454.CMB.1.raw
  modified_base (300)..(300): a, c, t, g, unknown or other
  misc_feature (300)..(300): n is a, c, g, or t
  modified_base (420)..(420): a, c, t, g, unknown or other
  misc_feature (420)..(420): n is a, c, g, or t
  modified_base (442)..(442): a, c, t, g, unknown or other
  misc_feature (442)..(442): n is a, c, g, or t
  modified_base (473)..(473): a, c, t, g, unknown or other
  misc_feature (473)..(473): n is a, c, g, or t
  modified_base (507)..(507): a, c, t, g, unknown or other
  misc_feature (507)..(507): n is a, c, g, or t
  modified_base (523)..(523): a, c, t, g, unknown or other
  misc_feature (523)..(523): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggttcaccgtcagtagcaactacatgagctgggtccncaggctccgagggaaggggccggagtgggtctcagttatttatggcggtgaaactacatactacgcagactccgtgaagggccgattcaccatctccagacgaccattacgaaagaacanattgtcctcttacaaatgaacngcctgagagccgagacacggcgtgtattacnggtgcgagaggtctacggaagtggcttagttcgntagtttcgactacggngggaccagggtaccc

SEQ ID NO: 200026 - DNA, 608 bp, Homo sapiens
  misc_feature: GYAE6OF02F1IC9.42.70.G04.1.454.CMB.1.raw
  modified_base (405)..(405): a, c, t, g, unknown or other
  misc_feature (405)..(405): n is a, c, g, or t
  modified_base (500)..(500): a, c, t, g, unknown or other
  misc_feature (500)..(500): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggttcaccgtcagtagcaactacatgagctgggtccgccgaggcctccgaggggaacggggccggaggtgggtctcgtagtttatttagtgggcggtagaaactacatactacgcagactcgtgaacgggcattcaccatcncagacgaccattcgaaagaacactattgtctacttacaaatgaaacacgcctagacgacgcccggaaggaccacgggccgttagttaacttacgngtcgacgaggaggttacctacggaaaggttcggtaccttaacggtttgaccgttaacgttttcggaaccgtttacgggtcgggggtacccgaacgggggtaacccccg

SEQ ID NO: 200027 - DNA, 564 bp, Homo sapiens
  misc_feature: GYAE6OF02F47VB.42.70.G04.1.454.CMB.1.raw
  modified_base (395)..(395): a, c, t, g, unknown or other
  misc_feature (395)..(395): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagcgtgggtccgccaggctccgaggggaacggggccggaggtgggtctcagttatttagtggcggtagaaactacatactacgcagctcgtgaacggcatcacatcncagacaccatcgaagaacacattcgtctcttacaaatcgaacagcctagacgagccggaggaccacgggtccgtagttacttacgtgtgacgagtagggtctacggaaaggttcggacgttacgttgaccttagtttcgaacttcggtgggggaccctaggggtacccg

SEQ ID NO: 200028 - DNA, 741 bp, Homo sapiens
  misc_feature: GYAE6OF02IC5TF.42.70.G04.1.454.CMB.1.raw
tcagtgacgtatgtcacgaccggtgctcgatttagtgtagtgtgaagggaaaggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtctggaggaggcttgaagcagccgtgggggtccctgagactctcctgtgcagcctcgttgggttccaccgtcaagtagcaactacatgacgcgtcgggtccgccaggcctaccggaagggggaacggggccggtaggtcgggtcctacgtaagtttagttttagcgggtacggtaacgtaaaactactaattacctaccggactaacggtaccgtccggtaacgggaaccggggtacccgtaacttaccaccctaacgttccctaaccgaagtacgaacccgttaacttaccggaaaacgtaaaccaccgttaatttcgttaccttacctttaacgaaaagttcgaaacgtacgtaccgtaggaacgtaacggacccggtaagggacccgtaccggggtccgttaagttaaccgtttcgtaggcggtacgtagggtacggttccgtaacggaaaacggttcggtacgttaaccggtttgacctttaacggttttcgaacccgttacgggttccggggaccctaccggggtaaccccg

SEQ ID NO: 200029 - DNA, 652 bp, Homo sapiens
  misc_feature: GYAE6OF02GPS6U.42.70.G04.1.454.CMB.1.raw
  modified_base (362)..(362): a, c, t, g, unknown or other
  misc_feature (362)..(362): n is a, c, g, or t
  modified_base (453)..(453): a, c, t, g, unknown or other
  misc_feature (453)..(453): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggttccaccgtcagtagcaactacatgagtcgtgggtcccgccaggcctccgagggaacggggccggaggtcgggtctctagttatttagtggcggtanaaactacataactacgcagactccgtagacggcattcacatctcagacgacctagttacgaagaacacattcgtctcttacaaatgaaacngcctagacgacgaccggagacgaccgggtccgttagttaacgtttaccgtggttacggaccgtaagggtacgggttaccgttaacggggtaaaacggttccgggaaccgtttaaccgggtttaggacccgtttaagtttttacgggaacccgtttaacgggtccgggggggtacccctaaacggggggttaaccccccg

SEQ ID NO: 200030 - DNA, 579 bp, Homo sapiens
  misc_feature: GYAE6OF02GENHG.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttccaccgtcagtagcaactacatgagctgggtccgccgaggctccgaggggacggggccggagtgggtctcgagtttattagtggcggtagaaactacatactacgcagactcgtgaacgggccattcacatctcagagacctattcgaaagaacactattcgtctacttacaaatgaacagcctgagacgccggaggaccgaccgggtcgtgttaattactggtacgcgagtaggtcctacggtaaaggtcgggtacttacgttgtactattttacggaccttacggtcggggtacccaaggggtaacccccg

SEQ ID NO: 200031 - DNA, 552 bp, Homo sapiens
  misc_feature: GYAE6OF02HKP2G.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctctgggttcaccgtcagtagcaactacatgagctgggtcccgcaggctccgaggggaaggggccggaggtgggtctcgtagttatttagtggcggtgaaactacatactacgcagactcgtgaaggccattcaccatcctcagacaccattcgaaagaacactattcgtctcttacaaatgaacagcctgagagccgaggacgacggccgtgtattacgtgtgcgaggagtctacggaagtcggactacgttcgactagtttcgaccgttacgtcggggaccacgggtacccg

SEQ ID NO: 200032 - DNA, 545 bp, Homo sapiens
  misc_feature: GYAE6OF02FVAOB.42.70.G04.1.454.CMB.1.raw
  modified_base (470)..(470): a, c, t, g, unknown or other
  misc_feature (470)..(470): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccgccaggctccgagggaagggccggagtgggtctcagtttatttagtggcggtgaaactacatactacgcagactccgtgaagggccgattcaccatctccagagaccatcgaagaacacattgtctcttacaaatgaacagcctgagagccgaggacacggccgtgtattcngtgcgagagtcgtacggaaaggtggactacgttgctagtttcgaccgttacgtcggggaccctagggtaaccccg

SEQ ID NO: 200033 - DNA, 590 bp, Homo sapiens
  misc_feature: GYAE6OF02IBQNO.42.70.G04.1.454.CMB.1.raw
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
  modified_base (453)..(453): a, c, t, g, unknown or other
  misc_feature (453)..(453): n is a, c, g, or t
  modified_base (464)..(464): a, c, t, g, unknown or other
  misc_feature (464)..(464): n is a, c, g, or t
  modified_base (519)..(519): a, c, t, g, unknown or other
  misc_feature (519)..(519): n is a, c, g, or t
tcagtgacgtatgtcacgaccggtgctcgatttagtgtagtgtgaagggaaagggggggaggaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtcgcacgtcctctgggttcaccgtcagtagcaactacatgagcgtcgggtccgccgaggcctaccgaagggggaacggggcccggaaggtcggggtctcgtaagtttagtttagngggacggtagaaaactacaatactacgnagtacctcgtggaagggccgtaattcgacccagtcctacagacgaccattacgaaanaacactagttntctactaacaaattcgaaacacgcctgaagcgaccgagacacgggctagtattcngtcgacgagacgtctacgaaggtcgactcgttgactagttacggacttacggcgggccgaacggtacccgg

SEQ ID NO: 200034 - DNA, 558 bp, Homo sapiens
  misc_feature: GYAE6OF02HRH9X.42.70.G04.1.454.CMB.1.raw
  modified_base (396)..(396): a, c, t, g, unknown or other
  misc_feature (396)..(396): n is a, c, g, or t
  modified_base (488)..(488): a, c, t, g, unknown or other
  misc_feature (488)..(488): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctcgtgggttcaccgtcagtagcaactacatgagctgggtccgccaggctccgagggaaggggccggagtgggtctcgagttatttagtggcggtagaaactacatactacgcagactcgtgaaggccattcacatccncagacgaccattacgaaagaacactaattcgtactacttacaaatcgaaacacgacctgagagaccgaggaccacggcgtgtacttacgtgngcgagaggtctacgaaggtcgactacgttgactagtttcgaccgttacgtcggggacctagggtaacccg

SEQ ID NO: 200035 - DNA, 740 bp, Homo sapiens
  misc_feature: GYAE6OF02I3UJE.42.70.G04.1.454.CMB.1.raw
  modified_base (306)..(306): a, c, t, g, unknown or other
  misc_feature (306)..(306): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcaggcctggggggtccctgagactctcctgtgcagcctcgtgggttccaccggtcagtagcaactacatggagcgtgggtcccncgacggcctaccgaggggaacggggccggaggtcggggtctcgtagtttatttagtcgggcggtagaaactactaatacctacgcagacctccggaggaaacgggtcctacttcaacctacgttccaccgagaaccgacctaacgtttacggaaacgtaaactacgtaactttgaccctttaccgttaacaaaagttcgaaaaccgtcgtacccgtaggtaaggaccggtacccgggaagggaacccgtaaccggggtaccggtttacggttaacgtttaaccggtgggtttaacggacccggtaagggtcgggtaccgtttaacgggaaaagggtttccgggtacccgtttaacggtttacggtaccgttaagtttttcggaaacccgttacgggttccggggggaccccgtaacccgggggttaacccccgg

SEQ ID NO: 200036 - DNA, 628 bp, Homo sapiens
  misc_feature: GYAE6OF02JK6EY.42.70.G04.1.454.CMB.1.raw
  modified_base (437)..(437): a, c, t, g, unknown or other
  misc_feature (437)..(437): n is a, c, g, or t
tcagtgacgtatgtcacgaccggtgctcgatttagtgtagtgtgaagggaaagggggggaggaggagcccagcactgggattccgaggtgtttccattcggtgatcagcactgaacacagaggactcaccatggagttttggctgagctgggttttccttgttgctatttaaaaggtgtccagtgtgaggtgcagctggtggagtctggaggaggcttgaagcagccgtgggggtccctggagacctctcctgtgcagcctctggttcaccgtcagtagcaactacatgagcgtggtcccgccaggctccgagggacgggccggagtcgggtctcgtagtttattacgtggcggtagtaaacctacgaatacgtacgacagaccctaccggtgaacgggcctattcacctatccgtacgagacgaccattacgaaanaacacattgtccttacgttactaaatcgtaaacgagtacctagacggtacggaccggaacggaccgtacgggtaccgttaggtactttacgtagtcgaccgaggtacggttactacgggtaaattcggtacttaacggttgtacccgttagtttcggaccgttaacggtcggggaccctacggggtacccg

SEQ ID NO: 200037 - DNA, 576 bp, Homo sapiens
  misc_feature: GYAE6OF02F3JL2.42.70.G04.1.454.CMB.1.raw
  modified_base (274)..(274): a, c, t, g, unknown or other
  misc_feature (274)..(274): n is a, c, g, or t
  modified_base (443)..(443): a, c, t, g, unknown or other
  misc_feature (443)..(443): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtnagtagcaactacatgagctgggtcccgccaggcctccgaggggaacggggccggaggtgggtctcgtagtttatttagtgggcggtagaaactacatactacgcagactcgtagaacgggccattcaccatctccagacaccattacgaagaacactattgtctcttanaaatgaacagcctgacgacgaccgaggaccgacggccgtagtacttactgtgacgtaggtacgtctacggtaaaggtcggtacttacgttgactagtttcggaaccttacggtcgggaccctagggtaccccg

SEQ ID NO: 200038 - DNA, 541 bp, Homo sapiens
  misc_feature: GYAE6OF02HJH0G.42.70.G04.1.454.CMB.1.raw
  modified_base (479)..(479): a, c, t, g, unknown or other
  misc_feature (479)..(479): n is a, c, g, or t
  modified_base (513)..(513): a, c, t, g, unknown or other
  misc_feature (513)..(513): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccgccaggctccgaggggaaggggccggagtggggtctcgagttatttatggcggtgaaactacaatactacgcagactccgtgaacgggccgattcaccatctccagacgaccattcgaaagaacactattgtactcttacaaatgaaacagcctgagagccgaggacacggcctgtattcngtgcgagagtctacggaaagtcgctacgtgactnttagaccttagtgggcctagggtacccg

SEQ ID NO: 200039 - DNA, 624 bp, Homo sapiens
  misc_feature: GYAE6OF02ITW02.42.70.G04.1.454.CMB.1.raw
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcgtgggggtccctgagactctcctgtgcagcctcgtgggttccaccgtcagtagcaactacatgagctagggtcccgccaggctaccgaggggaacgggccggagtcgggtctcgtagttattagtggcggtagaaactacatactacgcagacgtcgtaggacgggcctaattccacctatcctaccgaagacgaaccctagttaccgaagaaacctacatttcgtactccttacaaagtacaacacgccctagacggtacgcccgaaggacccgaccgggcccgttagttaattaccgtggtcgaccggagacgggttctaacggaaaggttcggacttaacggttcgcgttaagtttcggaaccttacgggtcggggaccctacggggtaacccg

SEQ ID NO: 200040 - DNA, 728 bp, Homo sapiens
  misc_feature: GYAE6OF02G7VLI.42.70.G04.1.454.CMB.1.raw
  modified_base (299)..(299): a, c, t, g, unknown or other
  misc_feature (299)..(299): n is a, c, g, or t
tcagtgacgtatgtcacgaccggtgctcgatttagtgtagtgtgaagggaaaggggggaggaggagccagcactgggattccgaggtgtttccattcggtgatcagcactgaacacagagactcaccatgagtttggctgagctggtttccttgttgctatttaaaagtgtccagtgtgaggtgcagctggtggagtcgtggaggaggcttgaagcagccgtggggggtccctggagactctcctgtgcagcctcgtggttcaccgtcaggtagcaactacagtcgagcgtgggtcccnccgaggcctccgaggggaacgggccggagtcgggtctcgtagtttatttagtgggcggtagaaactacaataccgtcgacaacgtactccggtaggaaacggggcccgtaacttccgaaacccacttcctacccgtaagaaccgtaaccctaacgtttacggaaaacgaactaacctaagtttcggtaccttacctttacgaaaaacttgaaaacccgacggtaccctaggaaacggacggaaccccggaagggttaaccccggaaccgggtccccggttagttaacgtttaccgtaggtcgggtacccgaagggtaccgggttacctacgggtaaaacggttcggtaccgttaaccggtttcgaaccgttagttttaccggaccggttaaccggtccggggggaacccaacccggggttaacccccgg

SEQ ID NO: 200041 - DNA, 631 bp, Homo sapiens
  misc_feature: GYAE6OF02IUN88.42.70.G04.1.454.CMB.1.raw
  modified_base (272)..(272): a, c, t, g, unknown or other
  misc_feature (272)..(272): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcgtggttttcgttgttgctattttaaaaggtgtccagtgtgaggtgcagctggtggagtctggaggaggcttgaagcagccgtgggggtccctgagactctctgtgcagcctctgggttcaccgtnagtagcaaactacagtgagcgtgggtccgccgacggctccgaggggaacggggccggaggtcgggtctcgtagtttattagtggcggtagaaactacatacgtacgcagactcggagaacgggccgtatccgacactcctaccgagacgacccattaaccgaaagaccataattcgtaccttattactaaaatcgaaacacgtcctaggacgaacgccggtaaggaccgtacggtccgttagtaacctttcgtggtacgacgtaggtacgtacgtaacggtaaaggtcggtaccgttacgttagcttaaacgtttcggaccttaccgggttacgggggaccgaaccgggttaaccccgg

SEQ ID NO: 200042 - DNA, 663 bp, Homo sapiens
  misc_feature: GYAE6OF02HB8BM.42.70.G04.1.454.CMB.1.raw
  modified_base (296)..(296): a, c, t, g, unknown or other
  misc_feature (296)..(296): n is a, c, g, or t
  modified_base (366)..(366): a, c, t, g, unknown or other
  misc_feature (366)..(366): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcaggccgtggggggtccctggacgactctcctgtgcagcctcgtgggttcaccgtcagtagcaactacatgancgtgggtccgccgaggctccgaggggacggggccggaggtgggtctcgtagtttagttagtggacggtanaaactacatactacgcagactcggaggacgggccgtattccaccactcctaccgaggacgaccctaagttaccgaaacgtaaaccactaagtttcgtaccttacttaaccaaaagtacgaaactacggtaccctagggacggacgtaccggaacgggaccaccgggtccgttacggtactttacgtggtcggacgtaggtacgggttcgtaacggtaaagggttcggaccgtttaacggttcgacgttacgtttcggaaccgttacgggtccgggggtacccgaacgggtaccccgg

SEQ ID NO: 200043 - DNA, 770 bp, Homo sapiens
  misc_feature: GYAE6OF02HXYM2.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccagtggtagttttggctgagtcgttcgggtttttccttggttgtacttaagttttaaaaggtgtccagttgtggaggtgcagcgtggtggagtcgtgggaggaggtcttaggaagcgaggccggttcggggggtccctggacgtacttcctccgtgtcgacgacgtccttcgttcgggttaccaccgtcgagtacgacaaacctactagtaggacgtcggttccgggtcccgccgacggtccgtaccgggaagggggaacggggccggtaggtcgggtcctacgtagttttagttagtcgggtcggtaactaaacgtactagtaaccgtacgacgacgtacccgtacggtagggaacgggccgtacttaccgacctactcccgtaccgaaggaaccgtaccctaaggttaaccgaaaacgtaacctactacgtttacgttccttacttaaaccaagttaaccaacgcgtactaggaacgtacgaccggaacgaccgaaccgggtccgttagttaacgttacggtgacggtacgacggtacggtaccgtaacgggtaaaggtccggttacgttaacggttggaaccgtttagttcggaacccgtttaacggggtccggggaacccgtaacgggttaaccccgg

SEQ ID NO: 200044 - DNA, 674 bp, Homo sapiens
  misc_feature: GYAE6OF02FJ0U6.42.70.G04.1.454.CMB.1.raw
  modified_base (448)..(448): a, c, t, g, unknown or other
  misc_feature (448)..(448): n is a, c, g, or t
  modified_base (577)..(577): a, c, t, g, unknown or other
  misc_feature (577)..(577): n is a, c, g, or t
  modified_base (599)..(599): a, c, t, g, unknown or other
  misc_feature (599)..(599): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtctggaggaggcttgaaggcgaggccgtggggggtccctggacgactctccgtgtgcagcctcgtgggttccaccgtcagtagctaactacagtgacgcgtgggtccgtcccgacgggtccaccggtacggggaacggggaccgggacggtcggggtctacgtagtttacgtttagtcggtacggtacgtaaactacgtatacgtacgacacgactcggtggacgggaccgactcgaccatcnccgagacgacctagtaccgaagaacacctattcgtacctactttaacaaacgtagtaaaccgacgtcccgtaggaacggacggtacccggaacggaacgtacccggggaccgttagtaacgtttaacgnggttcggaccgtaggtacggtntaaccgggtaaggtcggtcgttaccgttagaccttagttacgaccttacggtcggggaccgtaccgggtaacccg

SEQ ID NO: 200045 - DNA, 676 bp, Homo sapiens
  misc_feature: GYAE6OF02H79KH.42.70.G04.1.454.CMB.1.raw
  modified_base (303)..(303): a, c, t, g, unknown or other
  misc_feature (303)..(303): n is a, c, g, or t
  modified_base (410)..(410): a, c, t, g, unknown or other
  misc_feature (410)..(410): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctgggtggagtctggaggaggcttgaagcagccgtggggggtccctgagactctcctgtgcagcctcgtggttcaccgtcagtagacactacatgagcgtgggtccncccgaggccgtcgaggggacggggccggagtcgggtctcgtagttatttagtggcggtagaaactacatactacgcagtacctccggagacgggcattccacatccncgaagacgacccagttaccgaaacgaacactattcgtcttacttaaccaaagttcgaaactcgtacctaggaacggaccgggacccggaaagggcccgaccggggtaccggttagtttaacgtttaccgtggttaacggccgtaaagggtacgggtttcgtaaaccggggtaaggtttccgggaccgtttacggttacgcgtttacgtttaaccggtaaccttaaccggggttcgggggaccccggtaaccggggttaaccccggg

SEQ ID NO: 200046 - DNA, 645 bp, Homo sapiens
  misc_feature: GYAE6OF02G0M0M.42.70.G04.1.454.CMB.1.raw
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (525)..(525): a, c, t, g, unknown or other
  misc_feature (525)..(525): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcgtggttttccttgttgctatttaaaaggtgtccagtgtgaggtgcagctggtggagtctggaggaggcttgaagcagccgtggggggtccctgagactctcctgtgcagcctcgtggttcaccgtcagtagcaactacatgagctgggtccnccgaggctcgagggaaggggccggaggtggtcncgtagtttatttgnggcggtagaaactacataactacgacagactcgtacgaagggccgtattaccacctactcctaccaagacgaccaagttaccgaaagaacactattgtaccttattaaccaaatcgtaaacacgtccgttacgaagacgtaccgaacggtacgaaccggtccgttaagttactttacgnggttacgcggtaaggtacggttcgtaacgggtaaaacggttcggttacctaacggtttgaaccgttaattttccggaacctttaccgggtacgggggtaccctaacgggggtaacccccg

SEQ ID NO: 200047 - DNA, 721 bp, Homo sapiens
  misc_feature: GYAE6OF02F7DWN.42.70.G04.1.454.CMB.1.raw
  modified_base (181)..(181): a, c, t, g, unknown or other
  misc_feature (181)..(181): n is a, c, g, or t
  modified_base (218)..(218): a, c, t, g, unknown or other
  misc_feature (218)..(218): n is a, c, g, or t
tcagtgacgtatgtcacgaccggtgctcgatttagtgtagtgtgaagggaaagggggggtagaggagcccagcactgggattccgacggtgtttccattcggtgtatcagcactgaacacagaggactcaccatcggagttttgctgagctgggttttccttgttgtcttatttaaaggtntctagtgtgaggtgcagcgtggtggagtcgtggaggnggtcgttgaagcagccgtgggggtccctggacgacctctccgtgtgccagtcctcgtcggttccaccgtctagtacgacctaacttacagtagacgtcgtcgggtccgccgaggccgtaccggaggggacggggccggaggtcgggtctcgtagttagttagtggacgtagtaacgtactactacgtacgacgtacgacgttcggtaggacggaccgtacgtccgaccgtactacgtccaagactaccctagtacgaaacgactaactagttacgtactcttaacaaagttcgaaaccctgctaggacgaccgtaaccggaacggacgtacccgggtcgttagttaaaccttacggttcggtacggaaccgtagggaccgtttaccggtaacggttaaaagggtccggttaacctttaacccgggttacgtacgttttaacggtttccgtaaacccggttacgggggtcccggggtaaccggttaccccgggttaacccccgg

SEQ ID NO: 200048 - DNA, 615 bp, Homo sapiens
  misc_feature: GYAE6OF02IZ3YA.42.70.G04.1.454.CMB.1.raw
  modified_base (302)..(302): a, c, t, g, unknown or other
  misc_feature (302)..(302): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctcgtgggttcaccgtcagtacgcaactacattagctgggtccncgaggctccgaggggaggggccggaggtgggtctcgtagttatttagtggcggtagaaactacatactacgcagactccgtaggaacgggccgtattccaccatcctaccgagacgacctattacgaaataacactattcgtcttactaacaaagtacaacgacgccgtagacgacggccggaaggaccgaccgggcgttgtaacgttacgtggtcggacgagacgggttacaggtaaacggtcggtaccgttacggttgacttagtttacgacgttaccggtacggggacccgtacggggtacccctacggg

SEQ ID NO: 200049 - DNA, 663 bp, Homo sapiens
  misc_feature: GYAE6OF02HEPZB.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagcgtggtggagtctggaggaggcttagaagcaggccgtcgggggtccctgacgactctccgtgtcgcagcctcgtgggttccaccggtcagtacgacaactacagtgagcgtgggtcccgccgaggccgtaccgaggggaggggccggaggtcggtctcgtagtttatttagtggtcggtagaaactacgagtactacgcgacgacctcggtagaacggggtcctactaccacctactcctacacgactacctatacgaacgtaacacgtacttgttacctaccgttacaaagtacgaacctacgtacccgagtaacggacggaccggtaaccgggaccgtaccggaccggttagtaactttacgttaggacggaggtacggaggtaccgtacgggtaaaggtcggtacgttacggttcgtaacttagttacggtacctacggggtccgggtacggaccggtaacccgg

SEQ ID NO: 200050 - DNA, 600 bp, Homo sapiens
  misc_feature: GYAE6OF02GSF29.42.70.G04.1.454.CMB.1.raw
  modified_base (448)..(448): a, c, t, g, unknown or other
  misc_feature (448)..(448): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcacccggtcagtagcaactacatgagctgggtcccgccaggcctccggaggggacggggccgggaggtgggtctcaggtttatttagtgggcggtagaaactacatactacgcagactccggtagaacgggccattccacctatctccagacgacattacgaacgaacacattgtctcttanaaatgaacagcctagagacgccgaacggacgacgggccgtagttaacttacgtgtcgacgtaggtacggtcctacgggaaaggtcgggtacgttaacggttagacttagtttacgaccgttaccggtcggggtacccgaagggtaaccccgg

SEQ ID NO: 200051 - DNA, 659 bp, Homo sapiens
  misc_feature: GYAE6OF02FWV1P.42.70.G04.1.454.CMB.1.raw
  modified_base (276)..(276): a, c, t, g, unknown or other
  misc_feature (276)..(276): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggtttttcttgttgctattttaaaaggtgtccagtgtgaggtgcagctgggtggagtctggaggaggcttgaagcagccgtgggggtccctgagactctcctgtgcagcctgtcgggttcaccgtnagtagcaactacatgagcgtcgggtccgccgaggcctccgaggggaacggggccggaggtcgggtctcgtagtttatttagtgggtcggtagaaacctacactactacgcaacgtacctccggtaggaacgggccgtattccacctatcctcagacgacctagttacgaaagaacactatttcgtccttacttacaaatcgaaacagtccctaggaacgtacggccggaaggaccgacgggtccgtagttaattacgtgtacggacgtaaggtacggtccgtaacgggtaaaggttcggtaccgttacggttacggaccttaaggtttttccgaaaccggtttaccgggtcgggggtaaccccgtaagggggttaaccccccg

SEQ ID NO: 200052 - DNA, 666 bp, Homo sapiens
  misc_feature: GYAE6OF02J1VB7.42.70.G04.1.454.CMB.1.raw
  modified_base (252)..(252): a, c, t, g, unknown or other
  misc_feature (252)..(252): n is a, c, g, or t
  modified_base (365)..(365): a, c, t, g, unknown or other
  misc_feature (365)..(365): n is a, c, g, or t
  modified_base (524)..(524): a, c, t, g, unknown or other
  misc_feature (524)..(524): n is a, c, g, or t
  modified_base (580)..(580): a, c, t, g, unknown or other
  misc_feature (580)..(580): n is a, c, g, or t
  modified_base (589)..(589): a, c, t, g, unknown or other
  misc_feature (589)..(589): n is a, c, g, or t
  modified_base (625)..(625): a, c, t, g, unknown or other
  misc_feature (625)..(625): n is a, c, g, or t
tcagtgacgtatgtcacgaccggtgctcgatttagtgtagtgtgaagggaaaggggggaggaggagccagcactgggattccgaggtgttccattcggtgatcagcactgaacacagaggactcaccatggatttggctgagctggttttcctgttgcttatttaaaggtgtctagtgtgaggtgcagctggtggagtctggaggaggcttagagcaggccgtcgggggtcctggagactctccgtgtgacngtcctcgtacggttcaccgtcagtacgctaacgtacagtgagcgtcggtacccgcacgggcctacggagggaaggggcccggtaggtcgggttctcggtagtttaagtttagnggggtaccgtaaggtaaactacgtagtaccacggtacaacggtcctacggtggaaacgggtcccgtaattcccgaacccattccgtaccgaagaagacccgttaaattaccggaaacgaactaacctgtttaccgtcttaacgtaacaaagttcgaacngtcccgtgaacggtcaacccgggagaccgtaacccggtgtagttaacgtagttcgngaccggtancggttactacggaaacggttcggcttaaacgggttnacttggttacgaacgttcggtccggggaccgaggttacccg

SEQ ID NO: 200053 - DNA, 629 bp, Homo sapiens
  misc_feature: GYAE6OF02GLIA9.42.70.G04.1.454.CMB.1.raw
  modified_base (423)..(423): a, c, t, g, unknown or other
  misc_feature (423)..(423): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (523)..(523): a, c, t, g, unknown or other
  misc_feature (523)..(523): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctctgtgcagcctcgtgggttcaccgtcagtagcaactacatgagtcgtgggtccgccgaggtcctccggaggggacggggccggaggtcgggtctcgtagtttattagtggcggtagaaactacgaatacgtacgcacgtacctcggtaggaacggggcctattccaccacgttcnccaaggacacctaattacgaaacgaacactattctctcttanaaatgaacncgctggaagacgccgaaggaccgtacgggcccgttattacgtttaccgnggttacggacggtaggacgttaccgtaggtaaacggtcggttacttaacgggttgaccttagtttcggaaccgttacgggtcgggtaacccgacggggtaaccccg

SEQ ID NO: 200054 - DNA, 621 bp, Homo sapiens
  misc_feature: GYAE6OF02F83SW.42.70.G04.1.454.CMB.1.raw
  modified_base (273)..(273): a, c, t, g, unknown or other
  misc_feature (273)..(273): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtnagtagcaactacatgagctgggtccgccgaggctccgaggggaaggggccggaggtcggggtctcgtagtttatttagtgggtcgtagaaacctacaatactacgcagactccgtagaacgggccgtattccaccactctccagacgaccattacgaaagaacacattgtctcttacaaatgaaacacgcctgaagacgccggaaggaccgacgggccgttagttaacttacgtggttgaccgtaaggacggtacgtacggaaaaggttcggtaccgttaacggttcgaccgttaagttttcggaaccgttaaccggtcggggggacccctaagggggtaaccccccg

SEQ ID NO: 200055 - DNA, 758 bp, Homo sapiens
  misc_feature: GYAE6OF02HE5LX.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtcgtggaggaggcttgaagcagccgtggggggtccctgagactctcctgtgcagcctcgttgggttccaccgtcagtagacaactacatgagccgtcgggtccgccgaggcctaccggaaggggacggggccggaggtcgggtctacgtagtttatttagtgggacggtagaaactacatacctacgcacgtacctacggtaggacgggcctattaccacctactcctccgaagacgtaaccctagttaccggaaaacgtaaccctaacttactttacggtaccctttaccgtttaaacgaaaacgttcggaaaacctacggtaccccgttagggaaccggaaccgggacccgggtaaaccggggacccgtaacccggggttacccgtttaggtttaaaccgtttaccggttggtaacggacccgggttaagggtaccggttaccggttaacggtaaacgggttccgggtaccgtttaacgggtttcgacttttacgtttacggaacccgtttacggggtaccggggggtacccaaaccggggttaaccccgg

SEQ ID NO: 200056 - DNA, 846 bp, Homo sapiens
  misc_feature: GYAE6OF02HXSYN.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagcttgggttttccttgttgtcttattttaaaaggtgtccagtgtgaggtgcagcgtggtggagtcgtgggaggaggtcttaggaagcgacggccggttcggggggtccctggacgtacttcctccgtgtcgctacgccgttcgttcggttaccaccgttacaaggtacgaccaacttacagtggtacgtcgttcggggtcccgaccgacggtccgtaccgggaagggggtacggggaccggtaggttcggtccttacgtaagtttagtttacggtacgggtacggtaacgtaaactacgtacgttaacgtacgacgaacgtaccgttacggtaagggaaccggtaccgtaacttaccgacctattcccgtaccaagaccgtaacctaacgttaacggaaataacctagttacgttacttaccgttacttaacgtaaagtaccgaaagtccgtaccgaggtaaccggacggaacccggtaaggaaccccggtaaccgggttaccgtttaagtttaccgtttacgggtaggtacgtaaccggtacgggttacgggtttaacccggtaacgggtaaaacggggtttccggtaaaccggtttaaccggtttacggtaacgtttttaacggtttttacccgggaaacccggttttaccgggggtaacccggggtaacccccggttaaaccgggggttaaccccgg

SEQ ID NO: 200057 - DNA, 656 bp, Homo sapiens
  misc_feature: GYAE6OF02GAUFA.42.70.G04.1.454.CMB.1.raw
  modified_base (378)..(378): a, c, t, g, unknown or other
  misc_feature (378)..(378): n is a, c, g, or t
  modified_base (527)..(527): a, c, t, g, unknown or other
  misc_feature (527)..(527): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgagcagccgtggggggtccctgagactctcctgtgcagcctcgtgggttccaccgtcagtagacaactacatgagcgtgggtccgccgaggcctccgaggggaggggccggaggtgggtctcgtagtttattagtggcggtagaaactacatacgtacncacgactcgtagaacggccgatcacctatctccagacgaccagttaccgaaagaaccactagttcgtaccttacttaacaaagttacgaacacgacctaggacgacggacccgaagggacccgaccgggtccgtagtttaacgttacgnggttcgacggaggtacgggttacctaccggtaaaagggttcggtaaccgttacggtttcggaccttaaggttttaccggtaacggttaccgggtaccgggggtacccggtaacggggttaaacccccgg

SEQ ID NO: 200058 - DNA, 649 bp, Homo sapiens
  misc_feature: GYAE6OF02FG5FP.42.70.G04.1.454.CMB.1.raw
  modified_base (277)..(277): a, c, t, g, unknown or other
  misc_feature (277)..(277): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctcgtgggttccaccgtnagtacgcaactacatgagtcgtgggtcccgcaggtcctaccggaggggacgggccggaggttcgggtctcgtagtttagttagtgggacggtagaaactactagtaccacgcacgacctccggtaggaacggggcctaacttccacctactccgtaccaagacgacctagttacgaaacgaacactagttcgtacctcttacaaagtcgaaccagtccgtagacgtacggcccgtaaggacccgtaccgggccgttagttaacttacgtggtacgacgtaggtaccggtcgtaacggaaacggttcgggtacctacgggtttcgacgttagtttcggaccgttacggtcgggggaccctacggggtaacccg

SEQ ID NO: 200059 - DNA, 697 bp, Homo sapiens
  misc_feature: GYAE6OF02F37HH.42.70.G04.1.454.CMB.1.raw
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagcttgggttttccttgttgcttattttaaaaggtgtccagtgtgaggtgcagctggtggagtcgtggaggaggcttgaagcacggcccgtcgggggtcccgtgacgacctctcctgtcgccacgtcctcgtcgggttccaccgtcaggtacgcaactacatgagcgtcgggtcccgccgacggcctaccggaggggaacggggccggtaggtgggtctcgtagttagtttagtggtacggtacgtaaactacaactacgtacgcacggtactccggtaggaaccgggtccgtacgttacccaaccgtactaccgtaccgaagaaccgaccctaagtaacccgaaagtaacctactaacgtttcgtaccctacttaacaaacgtcgaaactacgtccgtagaacggtacgacccggaagggtaccctaccggggtcgttagttaacgtttaccgtggtacgaccgtagggtacggttccgtaaggaaggttcgacttacggtacgtacttacgttacgacccgttaggacccgggtacgacgggttaccccg

SEQ ID NO: 200060 - DNA, 630 bp, Homo sapiens
  misc_feature: GYAE6OF02H960O.42.70.G04.1.454.CMB.1.raw
  modified_base (318)..(318): a, c, t, g, unknown or other
  misc_feature (318)..(318): n is a, c, g, or t
  modified_base (490)..(490): a, c, t, g, unknown or other
  misc_feature (490)..(490): n is a, c, g, or t
  modified_base (540)..(540): a, c, t, g, unknown or other
  misc_feature (540)..(540): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagcgttgggtttttccttgttgcttaattttaaaaggtgtccagtgtgaggtgcagctggtggagtcgtgggaggaggcttgaagcagccgtggggggtccctggacgactcctccgtgtgcagcctcgtgggttccaccgtcagtacgacaactacatgagcgtcgggtccncccgaggtcctaccggaagggggaacggggccggtaggtcgggtctacgtagtttattagtggacggtaagaaactacatactacgcacgtactcggagacgggtcattccaccactcctacagacgacctatacgaaagaactatattacgtcttactaacaaatcgaacncgtacctagaacgacggaccggaaggccaccgggtctagttaacttccgnggtacgcggaggtacggtacctaagggaaggttcggacttaacggttgctttagttcggacttacgggtcgggaccccgagggtaacccc

SEQ ID NO: 200061 - DNA, 696 bp, Homo sapiens
  misc_feature: GYAE6OF02FY8ND.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgcttattttaaaaggtgtccagtgtgaggtgcagctggtggagtctggaggaggcttgaagcaggccgtgggggtccctgagactctcctgtgcagcctcgtggttccaccgtcagtagactaactacatgagcgtcgggtccgccgaggcctaccgaggggacggggccggaggtcggtctcgtagtttactttagtggtcggtagaaactactaataccgtacgcgtacgacctccggtaggaacgggtccgtattccaacctactaccctaccaagacgtaaccctagttaaccggaaacgtaaccaacttagtttcgtaccttacttaaccaaaagttcgaaaccacgtcccgtaggaacgtaccggacccggaaggtacccgaccgggtaccgttagttaacgttaccgtggtacgaccggtaaggtacggttaccgtaacgggtaaacggtcggtaacctttacggtagtaccgtttagtttaccggaaccgttaccgggacggggtacccgtacgggtaaccccgg

SEQ ID NO: 200062 - DNA, 698 bp, Homo sapiens
  misc_feature: GYAE6OF02FVSHW.42.70.G04.1.454.CMB.1.raw
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (602)..(602): a, c, t, g, unknown or other
  misc_feature (602)..(602): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcgtggttttccttgttgctatttaaaaggtgtccagtgtgaggtgcagcgtggtggagtcgtggaggaggcttagaagcagccgtgggggtccctgacgactctcctgtgcagcctcgtgggttcaccgttnacggtancctaactacagtgagcgttcgggtccgaccgcggccgtaccggaggggtaacgggggccgggaggttcgggtccttacgagtttatttagtcgggacggtagaaaacctacgaattaaccgtacgtacgaacggtaaccgttccggtaggtaaacggggccgtaacttccaaccctactccgtaccgaacggaacgtaccctagttacggaaaacgaacctaaacgtagtttacggtcccttaccgttaaacaaaacgttcgaaaatacccgtccgtagaacgacgggtacccgaaaggcctaacggggtctaagtnttaccggtacgcggtaaggcgtaccgtaggaacggttacggctaacggttcaagttacgtttgaacccgttaggccggggtaacccagggtccccg

SEQ ID NO: 200063 - DNA, 708 bp, Homo sapiens
  misc_feature: GYAE6OF02FNT7M.42.70.G04.1.454.CMB.1.raw
  modified_base (312)..(312): a, c, t, g, unknown or other
  misc_feature (312)..(312): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaggtgtccagtgtgaggtgcagctggtggagtctggagggaggcttgaagcaggccgtgggggtccctgagactctcctgtgcagcctcgtgggttccaccgtcagtagcaaactacatggagcgttcgggtcccgccgngggcctccggaagggggaacgggggcccggaggtggggtccttacgaaggttttaatttggtcggggacggttacggaaacctacattaaccgtacgacacggtaccttccggtagggaacggggacccgtaagtttacccacccgattcccgtaccgaacgtaccggaaccctagttaccgaaaacggaacctaactagttcgtaccttacctttaacaaaacgtcgaaaccgtcgaccgttagaacggcggaccggagaccgaacggtccgtagttacttacgtgtagacgggtagtacggtctaccgggaaaggttcggcccgttaacggttgtaaccgttattttaccgggaactttacggggcggggtacccggtaccggggtaaccccgg

SEQ ID NO: 200064 - DNA, 731 bp, Homo sapiens
  misc_feature: GYAE6OF02JNYYH.42.70.G04.1.454.CMB.1.raw
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (622)..(622): a, c, t, g, unknown or other
  misc_feature (622)..(622): n is a, c, g, or t
tcagtgacgtatgtcacgaccggtgctcgatttagtgtagtgtgaagggaaagggggggaggaggagcccagcactgggattccgaggtgtttccattcggtgatcagcactgaacacagaggactcaccatcggagttttggctgagctgggttttccttgttgcttatttaaaggtgtccagtgtgaggtgcagctggtggagtctgggaggaggtcgttgaaggcaggcccgttgggggggtccctggagaccgtctcccgtggtcgccaggcctcgtggggttccaccgtcagtacnccgtaactactatgacggctcggggtacccnccggacgcctacgacggggacgggcccgggaggtcgggtctacgtaggtttacttaggtgggacggtacgaaaccgtatacgacttacgggctaacgtaacggtccggttaggaacggggtccgtaattcccaactacgtcctaccaacggtacaacccgtacgttaaccgaaagaaccctaactacgtttccggttactacgttaacctaagtaaccgaactaccgtacgagtaccggtacgaccgggacggtaaccaccggggtaaccggttacgttagtttacccgnggtccgagtagggtacgtcgtacggaaaccgggttggtaccggttaacgttcgaacgttacgtttacggacgttacccgggttagggtaccccgtagggtaaccccggg

SEQ ID NO: 200065 - DNA, 552 bp, Homo sapiens
  misc_feature: GYAE6OF02FI4V5.42.70.G04.1.454.CMB.1.raw
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (469)..(469): a, c, t, g, unknown or other
  misc_feature (469)..(469): n is a, c, g, or t
tcagtgacgtatgtcacgaccggtgctcgatttagtgtagtgtgaagggaaagggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctcgtggggttcaccgtcagtagcaactacatgagctgggccgccaggctcgaggggagggccggaggtgggtctcgagtttatttagtggcggtagaaactacatactagcagactccgngaaggcattcacntcncaganacatcgaanacanttcnctctanaatnaacagctagagagccggagacgacggcgttatacttacgngtgtcgagtaggtctaggtaaagtcggacttacggtgacttagtttcggaacttcgggtacgggtaccggacgggtaaccccg

SEQ ID NO: 200066 - DNA, 646 bp, Homo sapiens
  misc_feature: GYAE6OF02GB7PV.42.70.G04.1.454.CMB.1.raw
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagcttgggttttccttgttgctattttaaaaggtgtccagtgtgaggtgcagctggtggagtctggaggaggcttgaagcagccgtggggggtccctgagactctcctgtgcagcctcgtgggttcaccgtcagtagcaactacatgagcgtgggtcccgccgaggcctccggaagggggaacggggccggaggtcgggtctcgagtttattagtgggcggtagaaactacatactacgcagactcgagaacggcctatccaccatctcagacgaccattacgaaacgaacactattacgtctacttaacaaagttacgaaccacgtcctaggaacggacggaccggaacggaccgacgggtcccggttagttacttacgtggtcgaccggtaggtacggtccgtaacgggtaaacggttcgggtaccgttaacggttcgacctttaagtttccggaaccgttacgggttccggggggaccctaaccgggggtaaccccgg

SEQ ID NO: 200067 - DNA, 714 bp, Homo sapiens
  misc_feature: GYAE6OF02I87YC.42.70.G04.1.454.CMB.1.raw
  modified_base (430)..(430): a, c, t, g, unknown or other
  misc_feature (430)..(430): n is a, c, g, or t
  modified_base (572)..(572): a, c, t, g, unknown or other
  misc_feature (572)..(572): n is a, c, g, or t
  modified_base (674)..(674): a, c, t, g, unknown or other
  misc_feature (674)..(674): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgctattttaaaaggtgtccagtgtgaggtgcagctggtggagtctgggaggaggtcgttagaagcacggccgtcggggggtccctggacgaccttcctccgtgtgccacgtcccgttcgttcgggttccaacccgtcgtaggttaacggcctaaacgttacagtaggacggtcggttcggggtcccgaccgacggccgtaccggaagggggaacgggggccggaggtcgggtctagtagtttatttagtggtacggtaagaaacctnaacttaacgtacgacacgtaccgttccggaggaacgggtcccgtattccaacctacgtccctaccgaaggtaaccaaccgtaagtttaaccggaaaacgaaacctaatactttacgtaccttacgttaacaaattacgaacnccgtaccgtagacggacgaccggacggaccgtaccgggtcgttagttacttacgtcgtagcggaagtacggtaccgtaggtaacggtcgtacttacggttancttagtttcggacttacgggtcgggaccgtacggtacccg

SEQ ID NO: 200068 - DNA, 687 bp, Homo sapiens
  misc_feature: GYAE6OF02HYY41.42.70.G04.1.454.CMB.1.raw
  modified_base (197)..(197): a, c, t, g, unknown or other
  misc_feature (197)..(197): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
  modified_base (289)..(289): a, c, t, g, unknown or other
  misc_feature (289)..(289): n is a, c, g, or t
tcagtgacgtatgtcacgaccggtgctcgatttagtgtagtgtgaaggggaaagggggggagaggagcccagcactgggattccgaggtgtttccattcggtgatcagcactgaacacagaggactcaccatggtagttttggctgagcttgggttttccttgttgctaattttaaaaggtgtccagtgtgaggtgnagctggtggagtctggaggaggcttgaagcgagccgtcggggggtccctgganacctctcctgtgcncgcctcgtggttccaccgtcagtanacaactacatggacgtcgtcgggtccgccgacggcctaccggaggggacggggccggtaggtcgggttctcgtaaggttttacttaggtggtacggtacgaaactacactaacgtacacgacgtacccgtcggtaaggaacgggccgtattaccacctactctacgagtacgaacttagtacgaaatacacttatcgttaccttacgttaacaaagtcgaaactacgtaccgtagacgggaacgtcccgggaaaggtacccgcgggttaacccgttgttaactttaccgtggtaccggcggtaacgggtaggttcctaaacgggaaggtttccggaacgtttccggtacgcttttaagttcgtacgttaaccggtggggaccctaacgggtaaccccg

SEQ ID NO: 200069 - DNA, 708 bp, Homo sapiens
  misc_feature: GYAE6OF02JMP8W.42.70.G04.1.454.CMB.1.raw
  modified_base (491)..(491): a, c, t, g, unknown or other
  misc_feature (491)..(491): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctgggaggaggtcttgaagcagccgttggggggtccctgagactctcctgtcgcagcctcgtgggttccaccggtcgagtagaccaactacatgagcgtcgggtcccgccgaggcctaccggaacggggaaggggcccggaggttcggggtcctacgtaggtttattagtgggtccggtagaaacctaactacgtactacgactacggtacctcggtaggaacgggtcccgtaatcccgaccgtaattcccgtacgaacgtaacgaccctaagttaaccggaaanaacctacgtactttcgtaccttacttaacaaacgtacgtaaacctcgacctaaggacggacggtaccggacggaaccggtccggtcccgggttattaaccgttacgtcggtacggtacggaaccggtaggttaccgtacgtaaacgggtcggtacgttacggttacaagtttcctttacggaaccgttacgggcggggtacccgtacgggtacccgg

SEQ ID NO: 200070 - DNA, 635 bp, Homo sapiens
  misc_feature: GYAE6OF02G2HYL.42.70.G04.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctgggaggaggcttagaagcagccgtggggggtccctgagactctcctgtgcagcctcgtgggttccaccgtcagtacncaactanatgagctgggtccgcaggcctcggaggggacggggcggaggtgggctgtagttattagtgggacgtagaactacatactacgcaacgacgtccgtaggaacgggtcctataccaccactcctccgagacgacctattacggaacgtaacactattcgtctcttacaaangtaaacngaccgtagacgacgtaccggaacggacgaccgggtcgttacgttacttacgtaggtagacgggtaaggtacgggttacctaagggtaaacgtcgggttaccttacggttgaccgtttaaggttttccgacgtaccgggttacgggacccggtaacggggtaaccccg

SEQ ID NO: 200071 - DNA, 653 bp, Homo sapiens
  misc_feature: GYAE6OF02FNW82.42.70.G04.1.454.CMB.1.raw
  modified_base (278)..(278): a, c, t, g, unknown or other
  misc_feature (278)..(278): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgacgactctccgtgtgcagcctcgtgggttcaccgtnacgtagacaactacatgagcgttcggggtcccgccgaggcctccggaagggggaacggggccgggaggtcggggtcctcgtaagttttatttagtgggcggtagaaacctacgaactacgtacgcagtacgtaccggtaggaacgggccgtattccacctactcctaccgaagacgacctagttacgaaacgtaacactattcgtcctacttaacaaatcgaacacgtaccgtgaacgacgaccggaaggccgaacggtccgtagtttaacttacgtggtacgcggaacggtggtactagggtaaacgtgggtacttaacggttgacttacgttttgaacccgttacgggtcggggacccgtaggggtaaccccg

SEQ ID NO: 200072 - DNA, 740 bp, Homo sapiens
  misc_feature: GYAE6OF02JJ37Q.42.70.G04.1.454.CMB.1.raw
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctatttaaaaggtgtccagtgtgaggtgcagctggtgagtctggaggagcttgaagcagccgtgggggtccctgagactctccgtgtcgcagcctcgtcgggttcaccgtcacgtagcaactacatgagcgtcggtcccgccgacggctaccgacggggaacggggaccggtaggtagggtctacgtaagtttagtttacgtggtcggtagaaaccgtactaagtacctaacggctaacgtaccgtaccggtacggtaacgggtacccgtactttacccgacctacgtcctaccgacggacgaaccgtacttacggaaacgtaaacacgtaagtttccgtactccttaacgaaacgttacgaaaccgtacgtacgtacggaaacggaccgtaccgggtaacggaaccgacccgggggttaccttacgggtttaagttacccgttggtaacggtaccggtaacggttacggttaccgtaacggttaaagggtaccgggttaccttaacggttacgtcttaacggtttaccggaaccgttaccggggtacggggtaccccgtaacgggtaacccccgg

SEQ ID NO: 200073 - DNA, 711 bp, Homo sapiens
  misc_feature: GYAE6OF02I1YBR.42.70.G04.1.454.CMB.1.raw
  modified_base (201)..(201): a, c, t, g, unknown or other
  misc_feature (201)..(201): n is a, c, g, or t
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (526)..(526): a, c, t, g, unknown or other
  misc_feature (526)..(526): n is a, c, g, or t
  modified_base (603)..(603): a, c, t, g, unknown or other
  misc_feature (603)..(603): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcttgggttttccttgttgcttattttaaaaggtgtcctagtgtgaggtgcagngtggtggagtcgtgggaggaggcttgaagcagccggtgggggtccctgagacctctccgtgtgcncgtcctcgtcggttcaccgtnacgtagaccaataccatgagcgtgggtccgccgtacggccgtaccggaagggggaacggggccgggagtacgggtcctacgtaaggtttatttaggtcgggtcggtaagaaaccgttatacgtacctacgcaacgtacctccggacggaacggtacctagttacccaccgtactccgacgaaggacccgtaactaagtacccggaaagtaacccacttattacgttccctaccttaaanaaaggttacactacggtcccgtaagggacggtaccggccggaagggacccgtcccggtacgttagttaacccgttangggtacacgggtagtacggtacttaaccgggtaaggtcgggtacctttagggttcgaaccttacggtttagaccgttcgggtacccgggacggtaaccggtaccccgg

SEQ ID NO: 200074 - DNA, 660 bp, Homo sapiens
  misc_feature: GYAE6OF02F4K6S.42.70.G04.1.454.CMB.1.raw
  modified_base (570)..(570): a, c, t, g, unknown or other
  misc_feature (570)..(570): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtggggggtccctgagactctcctgtgcagcctcgtgggttcaccgtcagtagcaactacatgagcgtgggtccgcaggcctccgaggggaacggggccggagtcggggtctcgtagtttatttagtgggcggtagaaactacaatactacgcaagaccttcccggtaggaaacgggtcccgtagttacccaaccgtattcctacccaaggacgaacccctaatttacccggaaaagtaaccaacgttagtttcgtccttacctttacaaaaacgttcgaaaccaggtccctaggaacgacgggaccgaagggaccaaccggggtccgttagttaacttacgnggttcgaccgtaggtacggtacgtacggtaaaggtcgtacgttacgtgactagtttcggaaccgtttcggcggggacctaacggggtccc

SEQ ID NO: 200075 - DNA, 783 bp, Homo sapiens
  misc_feature: GYAE6OF02GO4Z5.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctgggtggagtctgggaggaggcttgaagcagccgtggggggtccctgagactctcctgtgcacgcctcgtcgggttccaccgtcagtacgcaactacagtagagtcgtcgggtcccgccgacggcgtccgaggggacggggccggaggttcgggtctcgtagtttacgtttagtgggtacggtagtaaaaccgtacgtaactaaccgtaccgacgtaacgtaccgttacccggtaagggtaacggggacccgtaacgttcccaacccgtaacgttccgtacccgtaaaggtaaccgtaacccgtaaacgttttaaccggaaaaaacgggaaaccctaaaccgttaacgtttaacggttccctttaacccgtttaactaaaaagttaccgtaaaaccgtacgtacccgttagggaacggtacggaccggaacgggtaaccgaccggggtaccgttagttaacttacgtggtacgcgggtaagtcggttaccgtacgggtaaacggtcggttaccgttacggttacgtaccgttaggtttacgtacccggttacgggtaccggggtaccggaacccgggttaaccccgg

SEQ ID NO: 200076 - DNA, 675 bp, Homo sapiens
  misc_feature: GYAE6OF02GHOLW.42.70.G04.1.454.CMB.1.raw
  modified_base (451)..(451): a, c, t, g, unknown or other
  misc_feature (451)..(451): n is a, c, g, or t
tcagtgacgtatgtcacgaccggtgctcgatttagtgtagtgtgaagggaaagggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagccgtcggggggtccctgagactctcctgtgcagcctcgttgggttcaccgtcagtagcaactacatgagcgtcgggtcccgccagggcctaccgagggggaacggggccggaggtcgggtctcgtagtttattagtggcggtagaaactacgtatactacgcagactccgaggaacggccgtattccacctactcctccgaagacctacctagttaaccgaaanaacactatttacgcccttacgttaacaaaatcggaaaccacgtcccgtaagggaccgtaacggacccggggaacggacccggaccggggtcccttaaggttaacctttcgtcgggtcacgggtaagttcggtacccggtaacggaaaggtttcgggaccctttaaggttcaactttaggtttcggaaccttacggggtacggggaccccgtacgggtaccccgg

SEQ ID NO: 200077 - DNA, 769 bp, Homo sapiens
  misc_feature: GYAE6OF02GWNS3.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagtttggctgagtcttgggttttccttgttgtcttaattttaaaaggtgtccagtgtgaggtgcagcgtggtggagtcgtgggaggaggtcttgaagcgaggccggtcggggggtccctggacgtacctcctccgtggtcgctacgtcctcgttcgggttccaccgtacgagtaacgacctaaacctactagtacgaggccgttcgggtcccgacccgacggccgtaccgggaacgggggaaccggggccgggtagggtcgggtcctacggttaggttttaacgtttaggtcggggtacggtaacgtaaaacttacgtaacgtaaccgtaccgacgtaacggtacccgttaccggaacgggtaaccggggtacccgttaagttacccaaccgtaccttccgtaccgaaagtaaccggtaacccttaaagttaacccgaaaagtaaacccgtaaagtttcttacgttacccttacgttaaacaaagtacgaaacgtcgactaggaacggacgaccggaagcccgtacggtcgttattagtcgttgacggtcgaagtccggttataacggaagttggtaccttagttacgctttaaggttcgtaacgttcccgggacgggtaccgtaaccgggtccg

SEQ ID NO: 200078 - DNA, 640 bp, Homo sapiens
  misc_feature: GYAE6OF02IZDQM.42.70.G04.1.454.CMB.1.raw
  modified_base (394)..(394): a, c, t, g, unknown or other
  misc_feature (394)..(394): n is a, c, g, or t
  modified_base (461)..(461): a, c, t, g, unknown or other
  misc_feature (461)..(461): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgcttatttaaaaggtgtccagtgtgaggtgcagctgggtggagtcgtgggaggaggcttagaagcagccgtcggggggtccctgacgactctcctgtgcacgcctcgtgggttccaaccgtcaagtagaccaactacagtgacgtcgtcgggtcccgccgacggccgtccggaaggggaacgggggccggaggtcgggtctcgtagtttattagtggtcggtagaaactanatactacgcacgacgtcgtaggaacggccgtactccacctatcctacagacgacctagttacgaaanaacatagttcgtctacttaacaaagttcgaaactacgcctaggacggaacgtcccggaaggacccaccgggtcttaggtaacttagtcggaagtcgggagtacggtacgtaaggtaaaggtcggtacgttacgttcgcttaagttcgaccgttacgggcgggtaccgaccgggtaaccc

SEQ ID NO: 200079 - DNA, 750 bp, Homo sapiens
  misc_feature: GYAE6OF02IV8HR.42.70.G04.1.454.CMB.1.raw
  modified_base (263)..(263): a, c, t, g, unknown or other
  misc_feature (263)..(263): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtcgtgggaggaggtcttgaagcaggccgtggggggtccctgacgactcctcctgtgcncgccgtcgtcggttccaccgtcagtacgacaactacatgacgcgtcgggtccgccgaggcctacggaggggacgggggccggtaggtcgggtctcgtagtttagtttagtggtcgtacgtaaactactatacgtacgacacgactcggtaggacggcgtactcaccatccaccgagacgtactagttacggaaacactactagttccttacctacttaaactaaagaccgtaaacgaccgttccgtaaggaacgtacccggaccggggaacgtaaccggacccggggttcgtttaacgttaaacggttttcccaggggttaccgggacgggtaagggttacccgtttccggttaaaacgggtaacggggtttaccggtaccgttttaaccgggttcgttaaacccggttttaggttttccccggggttaaaccgtaaccggggttaccccgggggggtaaccccgtaaccggggtttaaccccccgg

SEQ ID NO: 200080 - DNA, 728 bp, Homo sapiens
  misc_feature: GYAE6OF02GRRL8.42.70.G04.1.454.CMB.1.raw
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
  modified_base (571)..(571): a, c, t, g, unknown or other
  misc_feature (571)..(571): n is a, c, g, or t
  modified_base (620)..(620): a, c, t, g, unknown or other
  misc_feature (620)..(620): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgcttattttaaaaggtgtccagtgtgaggtgcagcgtggtggagtcgtgggaggaggtcgttagaagcgacggtccgggttcggggggttccctggacgtaccttccgttccgtggtcgcgacgtcccgttcggttcgggttaccgacccggttcgaagtacgacctaaactactagtgacggtccggttaccggggtcccgaccggacggtcccgtaccgggaagggggtaaccggggcgggtaggtcgggtcctacgtagtttagtttggtgggtacggtaacgaaacctaacgtactaaccacgacgacgtaccgtccggtagggaacggcgtactaccacctactccaccgaagaccacctagtaacaaacganacgttnttctaccttataacaagtacaaacncgaccgagacggaacgcggaacgacccgtcggtgttattaacgttcggngcggaacggtaggtacgtcccgtaaagggtaacggtcggttaaccctaaggtcttaacgttaacgtttgggaccccgttaaggggccgggtaacccgacgggtacccg

SEQ ID NO: 200081 - DNA, 858 bp, Homo sapiens
  misc_feature: GYAE6OF02I2YNE.42.70.G04.1.454.CMB.1.raw
tcagtgacgtatgtcacgaccggtgctcgatttagtgtagtgtgaagggaaagggggggagaggagcccagcacgtgggtattccgaggttgtttcctattcggtgatcagcaactgaacacagaggactcaccgagttgggagttttggcgtgaggtctttgggtttttccttggtttgtactttaagtttttaaaaggtcgttaccgtaggttgtggtaggtgcgtagtcgtggggtggaggttcggtagggtagggtaggtcgttaggaacgcggtacggtccgggtcggggggttccctaggtacgtacgtccgtccgttggtcgcgtacgtccttcgttcggttaccaccgttagacgtacgacctaacttacgacgtggacgtccggtccgggtacccgcccggtacgggaccggttaccgggaacgggggtaacgggggtccggtagggttaccggtaccgttagttaacgttttaggtttaggtcggggtacggtaacgtaaacgtacgtaacgtacgttaccgacgacgtacccgtaccgggtaaggaaccgggtaccgttacgtacccggtaacctcgttaccctacgtaacggtaaccgtaacgtaaaccgttaaccggtaaaacgaaaccttaccgttaaatttccgttacctaacttaacgaaaagttacctaaacgacccgtacgtaggacgaaccggaaccgggaccgtaacggaccggttcgtaaccggtttatttaccggtagtccggggtaacgaggttccgtaggtaacgtaagggttccgtaccgtaacgttgaccgttatttcggacgtttacggaccgggttccgacggtacccgg

SEQ ID NO: 200082 - DNA, 851 bp, Homo sapiens
  misc_feature: GYAE6OF02H363L.42.70.G04.1.454.CMB.1.raw
tcagtgacgtatgtcacgaccggtgctcgatttagtgtagtgtgaaggggaaagggggggagaggagcccagcactgggattccgaggtgtttccattcggtgatcagcactagaacaacagagactcaccatggtagtttggctgagtcgttgggtttttcctgttgtcttaattttaaaaggtctccagtgtggaggtcgcagcgtggtggatcgtggaggagctgaagcagccggtcggggtcctgactactctccgtgtcgacacgtccgttacgtcggttacctaacgtcgaagtaacgacctaaaacctgaataggacgtacggtacggtcccaccggtaacggccgtaaccgggaaagggaacgggggtcccgtaagggtcggttaccttacggttaagttttaacggttaggtacggggtaccggttaaaacgtaaaaccctaacgtaacgttaaaccgtaaccgagtaaaccggtaacccggttaccggtaaacgggtaacccgggtaccgttaaactacccgtaaaacccgttacgtaaccgttaaccggaaacggtaacccgtaaacccggttaaacgttaaccgaaaaacggaaactaaccgttaagttaccggttactaacgttaaactaaagttaaccgaaacgtacgttaccgtaggaaacgacccggtaacggaaccggtaacggacccgggtacgttaacgtttaacgtacgtacggaagtaccgggtaaggaccggttacgtaacggaaaggtccggttaaccggtacgtttacgtccgttaaggtttacccgtaacgtttacggggaccgttaccggaaccggttaacccgg

SEQ ID NO: 200083 - DNA, 742 bp, Homo sapiens
  misc_feature: GYAE6OF02HBF1A.42.70.G04.1.454.CMB.1.raw
  modified_base (290)..(290): a, c, t, g, unknown or other
  misc_feature (290)..(290): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcgaccatggagttttggctgagctgggttttccttgttgctattttaaaaggtgtccagtgtgaggtgcagctgggtggagtcgtgggaggaggcttggaagcgaggtccgtcggggggtccctggacgactctcctgtgcacgcctcgtagggttccaccgtnaagtagacaactacatgacgcgtcgggtccgccgaggcctccggaggggaacgggggccggaggtcgggtcttcgagtttattagnggcggtanaaactactataccgtagcaagtactccggtagaacgggccgtacttaccaaccgtactccgtaccgaagaccgtaaacctacgtttaaccgaaaacgaaacctaactatttacgtaccttaccgttaaacaaaacgttacgaaacctacggtaccgttacggaaggaaccggtacccggaacgggaccggtaaccgggtcccggttaagtttaacgtttacgttaggtacggtacgaacgggtagggttacctaacggggtaaaaggtcgggtaccgttaacgttcggtaacgttaggtttttacccggaacggtttacccgggtacgggggtaccccgtaaaggggtaaccccccgg

SEQ ID NO: 200084 - DNA, 663 bp, Homo sapiens
  misc_feature: GYAE6OF02H86CA.42.70.G04.1.454.CMB.1.raw
  modified_base (301)..(301): a, c, t, g, unknown or other
  misc_feature (301)..(301): n is a, c, g, or t
  modified_base (388)..(388): a, c, t, g, unknown or other
  misc_feature (388)..(388): n is a, c, g, or t
tcagtgacgtatgtcacgaccggtgctcgatttagtgtagtgtgaagggaaaggggggggagaggagcccagcactgggattccgaggtgttccattcggtgatcagcactgaacacagaggactcaccatggagttttggctgagctgggttttccttgttgctatttaaaaggtgtccagtgtgaggtgcagctggtggagtcctggaggaggtcttgaagcaggccgtcgggggtacccttgacgactcgtcctgtgacacgccttcgtcgggttcaccgtcaagtacgcaaacctanagtgaaggtccgtcggtaccgccgtacggccgttaccggaggggtaacggggtaccggaggttcgggtacttcggttttaatttagngggtaaccggtagaaactacatacctacgacacgactacgtaggaacgggtcacgttacaaccgattacccgtcaacggaacacctaattaacggaacgaaactacgtaatttacgtacctaaccgtttacaaaagttcgaaactcgaccgtagagtaccgcggaagacgacggcctagtattacgtaggctggacgaggttccaaaggtacgtggtacgtacgtgtaccttaagttcgactaacgggttcgggaactaccggggtactaaccgg

SEQ ID NO: 200085 - DNA, 771 bp, Homo sapiens
  misc_feature: GYAE6OF02GIF3G.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgtctattttaaaaggtgtccagtgtgaggtgcagctggtggagtctggaggagctgagcagcgtcgggggtcctgacactctcctgtgcagcctcgtcggtccaccgtcacggtagacctaactactagtagacggcgtcgggtcccgaccgaggtccgtaccggtaacgggggaacgggggtccggaggttgggccttacgtagttaagtttagtcgggtacggtacgaaactacattacacgacgacgtacgtacggtagaccgggactacttaccacgtactacctaccgaaggtaaccctaccgtaacgttaggaaaacctaaacgtacccgtttattacggtttaccccttaaccgttttaaaagaaaccgttaagggtaaaaccctacgggtacccttaagggggaccgaacccgggtaacccggggaaacccgggttcaaaccccgggggtttcttaacgttttaaaccgggtacttacggggcgtaaacggtccgggtaacggggttccttaacggggaaacggttcggttaccgtacggttactacggtttagttacccgtaacgtcccgggtaacggggaccctaccgggttaccccgg

SEQ ID NO: 200086 - DNA, 908 bp, Homo sapiens
  misc_feature: GYAE6OF02F54PL.42.70.G04.1.454.CMB.1.raw
  modified_base (260)..(260): a, c, t, g, unknown or other
  misc_feature (260)..(260): n is a, c, g, or t
  modified_base (827)..(827): a, c, t, g, unknown or other
  misc_feature (827)..(827): n is a, c, g, or t
tcagtgacgtatgtcacgaccggtgctcgatttagtgtagtgtgaagggaaagggggggagaggagcccagcactgggattccgaggtgtttccattcggtgatcagcactgacacagaggactcacatggagtttggctgagctggtttccttgttgtcgttaatttaaaaggtgtaccagttgtgacggtgcagctggtggagtcgtggaggagcttgagcaggtccgtgggggtcctgacggtactcgtcctaggtnccgacgtccgtcgttcggttacaacccgtcgtagtacgtacgtaaaccttacgagtacggaggtccgttaccgggggtaccctacccgaggttacccggtccggaacgggggaaacgggtccggggtaacggtttgggtacccgtacgttaaggtttacggttttaacgtacggggtggttaaccgtaaaacgttaaccgaagttaaccgttacccggtacgaaccgttacccgttaccgggtacggtaacggggacccttacggttaacaaccccggtcgtaacccgttccccggaaagtaaaccccgggtttaacccgtaagtttaaaccccggggaaacttaaccggacctttaaacgggttcctaaccctttacccgtttaggaaaaactccgttaaaaccggtctaaccgggtattaaccggaacccggtcccgggtaaacggtacccggtaacccctaggggtttacgtttaacggttaccctggggtacctaaccgggtacgtttacccgggaccgttaaagggaccccgggtttaaggaccccgttttaacggggtttntaaccccgggtttaggtttacgggtaaaaccccccgtgggggtttaccgggttaacccccggtaaccgggttaaccccggg

SEQ ID NO: 200087 - DNA, 715 bp, Homo sapiens
  misc_feature: GYAE6OF02HO80U.42.70.G04.1.454.CMB.1.raw
  modified_base (589)..(589): a, c, t, g, unknown or other
  misc_feature (589)..(589): n is a, c, g, or t
  modified_base (627)..(627): a, c, t, g, unknown or other
  misc_feature (627)..(627): n is a, c, g, or t
  modified_base (672)..(672): a, c, t, g, unknown or other
  misc_feature (672)..(672): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgacggtcgttcgggtttttccttggttgtacttaagttttaaaaaggttcgtcctaggtgtggaggtgcagtcgtgggtggtagtcgtgggagggaggtcgttgaagcgaggccggtcggggggtccctggacgtcctcctccgtgtcgcacgtccgtcgtcggttccaccgtcagtacgtacaacgtactagtgcgtcggtcggtccgaccgacggccgtaccgggagggggaccgggggccggtacgggttcggtcgtacgttagtttaaggttcggtgggacggtaactaaactactacgtactaccgacgacgtaccgtacggtaacggtaccggtcctaccttaccacctactcccgtaacgaccgtaaacgtacccgtaagttaacggaaacgttaaccagtttacgttcttacttacctaagtaactacggacgtacncgagcgaacggcgacggacgcggtactagttacgtcgngagtcgaggacgtacgtaagtaacggtccggtacttcggttacgnttacggttcaacggttcgggaccgggaccgtaacgggttcccg

SEQ ID NO: 200088 - DNA, 772 bp, Homo sapiens
  misc_feature: GYAE6OF02H9D2X.42.70.G04.1.454.CMB.1.raw
  modified_base (305)..(305): a, c, t, g, unknown or other
  misc_feature (305)..(305): n is a, c, g, or t
  modified_base (552)..(552): a, c, t, g, unknown or other
  misc_feature (552)..(552): n is a, c, g, or t
  modified_base (575)..(575): a, c, t, g, unknown or other
  misc_feature (575)..(575): n is a, c, g, or t
tcagtgacgtatgtcacgaccggtgctcgatttagtgtagtgtgaagggaaaggggggagagagcccagcactgggattccgaggtgtttccattcggtgatcagcactgaacacagagactcaccatggtagttttggctgagcgttgggtttttccttgtttgtcttaagtttttaaaaggtgtccagttgtggaggtgcagcgtgggtggagtcgtgggaggaggtctagaagcgacggtccggtcgggggtccctgacgtactcctccgtgtcgacacgtccttcgtcggttaccaccgtnagtacgactaactaacagtagacgtcggttccgggtccgcccgacggccgtaccgggaagggggaacgggccgggtaggttcgggtacttacgttagtttagtttagcgggtacggtaactaaactactaacttaaccgtacgactacgtaccgttcggtaaggtacgggtaccctacgtttacccaaccgtacttacccgtaaccgaaggaacccgtacccttaagttaaccgaaaataaaccgtnttacgtttcgttacttaacttanaaaacgtcgaaacgacgttcgaaggacgacggaccggtaaggacccgtacgggttacgttagttaaactttcggtggtaccgacggacggttaccggttacgttaaagggacgggttccgtacgttaccggtttagaccgttttacggttacgtaaccggttaccgggttacggggaaccccctacggggttacccc

SEQ ID NO: 200089 - DNA, 765 bp, Homo sapiens
  misc_feature: GYAE6OF02GK7AU.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgctattttaaaaggtgtccagtgtgaggtgcagctggtggagtctggaggaggcttgaagcagccgtgggggtccctgagacctctcctgtcgcacgtcctcgtcgggttccaccgtcaggtacgacaactacatgacgtcggtcgggtcccgccgacggccgtaccggaacgggggaacgggggccgggagggttcggggttcctacgttaacggttttagtttaacggtgggtacggttaacgtaaaccttaacaactaacgtaccgacgaacgtaccgtacggtacggaacgggtaccgtacttaccaaccctactcctaccgaacggtaaccgtaacccttaagttaaccgggaaacgtaaacctacgttaactttcggtaccctttacttaaacgtaaagttacgaaaccgtacgtccgttaaggaacgggtacccggaacccgggtaagggacccgtaaccggggtccgttaacgttaacgtttaccgtggtacggaccgtaggtcggttaaccgaggtaacggttacggtccttaacggttcgactttaacgttcgtaaccggttacggtccggggaccgtaaccgggttacccg

SEQ ID NO: 200090 - DNA, 899 bp, Homo sapiens
  misc_feature: GYAE6OF02HEF66.42.70.G04.1.454.CMB.1.raw
  modified_base (523)..(523): a, c, t, g, unknown or other
  misc_feature (523)..(523): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagtcgttcgggttttccttgttcgtctttaagtttaaaaggtgtccaggtgtgaggtgcagtcgtgggtggacgtcggtagggacgggtaggccttaggaacgtcgacggtccggtcggggggttacccgtaggaaccggtaccttcccgttccgttcggttcgaccgtaaccggtccgtttccgggtttccggggtttaacccctaacccggtaccgttaaaggttaccggaacctaaacttaacgacgttacggacggtaccgggttccgggttaccccgaacccggaacgggtacccggtaaccgggaaccggggggaaacgggggtccggggtaagggttcggggtacttaccgttaaggttttattttaacggnggggttaaccggtaacgtaaacgtacgtaaccgtaacgttaaccgacgtaacggttaaccgtcggtcgggaaaccgggtcccttacgttacccgaaccgtacttaaccgtccgaacggtacgaacccgttaaagttaaccgaaaacgtaaccgtacttaaacgtttacgtacccttaactaaacgttaaacgttactaaacccgacttccgtaaagaccggtacggaccgggtaacgacgacgggttaccgttacgttacgttaagtcgtacggtacggtacggtacgggtacgaacgggtaaggttaggacccgtttagacgttgttaacgtttcgaaccgggttacggttacggggacccgtaacggtccccgg

SEQ ID NO: 200091 - DNA, 798 bp, Homo sapiens
  misc_feature: GYAE6OF02GCXPS.42.70.G04.1.454.CMB.1.raw
  modified_base (672)..(672): a, c, t, g, unknown or other
  misc_feature (672)..(672): n is a, c, g, or t
  modified_base (683)..(683): a, c, t, g, unknown or other
  misc_feature (683)..(683): n is a, c, g, or t
  modified_base (729)..(729): a, c, t, g, unknown or other
  misc_feature (729)..(729): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagtcgttcgggtttttcctttgttgtctttaaagtttttaaaaaggttcgtaccgaggttggtagagggtgcgagtccgtgggtggtacgtcgtgggacgggaggtctttaggaacgcgtaccgggtcccgggttccggggggttcccctaggtaccggtaccttccgttccgttggtcggaccgacgtcccgttcggttcgggttccctacccggtacgacggtaacggtacctaaacgttacgagttaggacgtccgggttacgggtccccggaccggacggttccggtaccgggaacggggggaacgggggtccggggaagggtttcgggtccttacggttaaggtttttacgtttcggtcgggggtaccgttaaggtaaaccttaacgtacgtaaccgtaccggtacgaaccggttaccgttaccgggttaaggggaccgggtaccgtacgtttacccaccgtacccttcgaccgaagtacccacgtaacgttacaaacgactacttattcgtaccttctaanaatacaacgcnctagacgcgacggacgtaccgcgtaccgttgttacttcgtagtcgngtagcgtacgacggtgtcgtcgtaacgtgtcttaggtactaccggtcggcgggtacgtaccggtaccgg

SEQ ID NO: 200092 - DNA, 856 bp, Homo sapiens
  misc_feature: GYAE6OF02FK71A.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcgtggttttcctgtagctatttaaagtgtcagtgtgaggtgcagtctgggtggagtcgtgggacggaggtcgttaggaacgccacggtcccggttcgggggggtccccttaggacgtccttccttcccgtgtcgccagtcccgttcgtcgggttcccaccggtcagtacgacctaaccagtacgaggacggtccggttccgggtacccgaccgtacgggccaccgggaaggggggtaaaccggggtcccgggtaggtttccggggttcctacgtaagtttttaacgttttacggcgggggtacggttaacgtaaaaccgtactaacgttaaccgaccgtacgtacggtaccccgtaccgggttaggaacgggttccccgtaacttaccaaccctactcccgtaccaacggacctaaacctcgttaaacaaaacggtaccctaacgtacgtttctaccttaccttaaaccgtaaattacccgggaaaacgcgttaccgaggtaaaccggaacgggtacccggaaggaaacccgttcgggttacccttaaagggtttaccgttaaccggttgggtacggaaccgggtacgtacgggtaccggttaaccgggtaaaggttcccgggtaactttaaccgggtttccagttttaaacgttgggtaaacccgggttacccggtaccggggggtaccctaacccggggttaaccccg

SEQ ID NO: 200093 - DNA, 580 bp, Homo sapiens
  misc_feature: GYAE6OF02FZGKD.42.70.G04.1.454.CMB.1.raw
  modified_base (220)..(220): a, c, t, g, unknown or other
  misc_feature (220)..(220): n is a, c, g, or t
tcagtgacgtatgtcacgaccggtgctcgatttagtgtagtgtgaagggaaagggggggggagaggagcccagcactgggattccgaggtgtttaccattcggtgatcagcactgaacacagaggactcaccatggagttttggctgagcttgggttttccttgttgctattttaaaaggtgtccagtgtggaggtgcagctggtggagtcgtggagggnggcttgaagcagccgtgggggtccctgagctcgtcctgtgcagcctcgtggttcaccgtcagtacgacaactacatgagcgtgggccgccaggctcggaggggaacggggcggaggtggtctacgtagtttattagtcggcgttagaactacatactacgacacgtctccgtaggaacggcacgtacacctacgtctaccgagacgacctagtaacgaagaacatacttcgtactcttaacaatcgaacacgtctaggacgacgacggagaccgcggtcgtagttactacgtgcgacgagtacgactagtagtcgtcgtacgttcgatacgttcgacgttcgcggtaccgaggtacccgg

SEQ ID NO: 200094 - DNA, 1059 bp, Homo sapiens
  misc_feature: GYAE6OF02JJ51E.42.70.G04.1.454.CMB.1.raw
tcagtgacgtatgtcacgaccggtgctcgatttagtgtagtgtgaagggaaaggggggggagaggagcccagcactgggattccgaggtgtttccattcggtgatcagcactgaacacagaggactcaccatggagtttggctgagtctggttttccttgttgcttatttaaaaggtgtccagtgtggaggtgcagcgtgggtggtaggtcgtagggagggtagggtcgttaggaacgcgacggtcccgggttcggggggggttcccctaggacggtaaccttccgtcccgtggtcggcctacggtcccctccggtttcggggttacccgtaaccccggttacgaacggttaacggtaacctaaaacctaaccgtaggttacggaacggtccgggttccggggttcccccggacccggaccggggacccgttaccccggggacgggggggtaaaccgggggggtcccggggtacggggttaccgggggttaccgtttaccgggttaaggtttttaaacgttttaacggggttacggggggtaccgggtttaaacgggtaaaaacccgttaaccgtaacgttaaaccggttaacggtaaccgtaaaccgtacccgggttacccgggtaacggggtaaacccggggtaacccgttaacgtttaacccgtaaacccgtaacgtttccctaacccgggtaagtaacccggtaaacccgtttaaacgtaaacccgggtaaaacgaaaacccgttaaccgtttaagtttaccggttaaccctttaccgttaaaacggtaaaactaaaccgggaaaacccttacgggtaaccccgtaggtaaacccgggaacggtccccggtaaaacgggttaccccggtaacggggttaccccgttaagggttttaacctagggttccggtaaaggggacccgggttaacggtacgggttaccggtaaccgggtaaaggttccgggttacggtttaacccgggttacgaccgtttaagttttccgtaacggggttacccggtacgggggaaccccggtaaccgggttaacccggg

SEQ ID NO: 200095 - DNA, 862 bp, Homo sapiens
  misc_feature: GYAE6OF02J104U.42.70.G04.1.454.CMB.1.raw
  modified_base (769)..(769): a, c, t, g, unknown or other
  misc_feature (769)..(769): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagtttggctgagcttgggttttccttgttgacttatttaaaaggtgtcagtgtgaggtgcagctggtggagtctgggaggaggtcttgaagcgacggccggttcggggggtccctaggagtacctccgtccgttggtcggaccgcgtcccttcggttacggggttccaccggttccgaacggttacgacctaaacctaacgacgttaggaacggtccggttggggtcccccggtaccgtaacggggtcccgtacccgggaaggggggtaaacggggggtcccgggtaaggggttcggggttccgttacggttaaggttttaacgttttacggggacggggttacgggtaaactaaaacttaaccgtaagttaaacccgacgtaccgtaacggtaccccgttacccgggaaggtaaacccggggtcccgtaactttacccgtaacctaaccggtttaccctaaccccgggtaaagacccgttaaaccccgttaagtttaaacccggaaacgtaaacctaaccgtttacgtttccgtaaccttaccgttaaacaaacgtttaaccgaacgttcgaaaccgtgaacggtaccgtaccggaacggtaccgacccgggtagtaccgtttaagacgttggngacgagtacgttacgaacggtaacgggttcgaaccgttcgttagtacctaagtttaccgaccgtagggtccggtaccccgtaggtaaccccgg

SEQ ID NO: 200096 - DNA, 842 bp, Homo sapiens
  misc_feature: GYAE6OF02HVTJF.42.70.G04.1.454.CMB.1.raw
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgcttattttaaaaggtgtccagtgtgaggtgcagctggtggagtctggaggaggcttgaagcagccgtggggggtccctgacgactctcctgtgcagcctgtggttcaccgtcagtagacaactacatgagcgtgggtccgcccgaggcctaccggaggggacgggggccggaggtcgggtctntagttattagnggtacggtagaaactacagtacctacgcgacgtacctcggtaggaacgggccgtattaccgacctacgtccctaccgaaggaccgtaacccttaagttacccggaaaacgtaactaacgttagtttacgtacccttacttaaaccgtaaaacgttacgaaacccgtaccgtaccccggtaaggaaccgggtaaccgggtaaccccggggaaagggtaaccccggtaaccccggggggttaccggtttaacggtttaaaccgtttttaacccgggtggttacccggtaaccggggtaagggttaacccggggtttacgtaaacccgggggtaaaagggttttcccggggaacccgtttttaaccgggtttacggtaaacccttttaaccgggttttttaacccgggggaaacccgttttaaacccgggggggtttacccgggggggaaccccccggtttaaaagggggggttaacccccccccgg

SEQ ID NO: 200097 - DNA, 717 bp, Homo sapiens
  misc_feature: GYAE6OF02JDGMB.42.70.G04.1.454.CMB.1.raw
  modified_base (445)..(445): a, c, t, g, unknown or other
  misc_feature (445)..(445): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagcttggtggagtcgttgggagggaggcgtttgaaggcgagtccgtggggggttccctgacggtactcctcctgtgcagtcctcgtcggttcaccgtgagtagcaactcatgagcgtggttcccgcgaggtcctccggaggggaacggggtccggaggttcgggtcttacgtaaggttttatttacgtggggtcggtaagtaaccgtactacgtacgtaccgcgtaagtccgtcggtacggaagggaccttntaccgactacgactacgacgacgtaaccctagttaccgaaagaactactacgtttcgttactactttaacgaatacgaaacgacgtcccgtaggaacaccggacggtaacgggtaccaccggggtactttacggttaaacgtttccgtggtacggtagacggtaccgggtttcaacgggtaacggttacggtaccgttaacgtggtttacttaccgggttttacgtaaccggtttcgggtaccgggggtaaccctaccggggtaaccccggg

SEQ ID NO: 200098 - DNA, 697 bp, Homo sapiens
  misc_feature: GYAE6OF02GU1N6.42.70.G04.1.454.CMB.1.raw
  modified_base (378)..(378): a, c, t, g, unknown or other
  misc_feature (378)..(378): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcgttgggtttttccttgttgacttattttaaaaggtgtccagtgtgaggtgcagctgggtggagtcgtgggagggaggcttagaagcagccgtggggggtccctgagactctcctgtgcacgtcctcgtcgggttaccaccgttcagtacgcaaactacatgagcgttcggtacccgcgaggcctccggagggggacggggccggaggttcgggtctcgtagtttatttagnggtcggtaagaacgtaacatactacgcaacgtactccggtaggaacggggccctattacccgacctattccctaccgaggaactaccctagttaaccgaaaagtaacctaactaggtttcgttctacttaacgaaacttgaaacagtccgtagaagcgaccggtagaccgaccgggtccgtagtttaccttaggtcgtacgggaccgtagggtacggtttaccgtaagggtaaacggtcgggttacccttagggttactacggtttaatttccggggaacctttaccggggcggggaccccggtaacggggtaccccgg

SEQ ID NO: 200099 - DNA, 716 bp, Homo sapiens
  misc_feature: GYAE6OF02IGI5D.42.70.G04.1.454.CMB.1.raw
  modified_base (287)..(287): a, c, t, g, unknown or other
  misc_feature (287)..(287): n is a, c, g, or t
  modified_base (395)..(395): a, c, t, g, unknown or other
  misc_feature (395)..(395): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatgagttttggctgagctgggttttccttgttgctattttaaaaggtgtccagtgtgaggtgcagcgtggtggagtctggaggaggcttgagcagccgtgggggtccctgacgactctcctgtgcacgcctcgtggtccaccgtacagtagcaactanatgagtcgtacggtccgccgaggccgtaccggaggggacggggccggaggtcgggtctacgtagttagtttacggtgggtacggtacgaaactaccagtacgtaccgngaacgtaccgtacgacggtacgggcctacttccaacctactaccgtacaggacgtaccctaagttaacggaaaacaacctacgttactttacgtaccttttaacgtaactaaaacgttacgaaacgtcgtaccctagggaaacgaccgtaaccggtaagggaacccgaccggggtacccgttaagtttaccgtttaaccttgggttacgaccggtaagggaccgttaggtacccggtaaagggttcgaccgtttaaggttcgacgtttactttacggtaaccgttcgggtacccggggtccgtaaccggggttaaaccccg

SEQ ID NO: 200100 - DNA, 728 bp, Homo sapiens
  misc_feature: GYAE6OF02JM4KK.42.70.G04.1.454.CMB.1.raw
  modified_base (250)..(250): a, c, t, g, unknown or other
  misc_feature (250)..(250): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
tcagtgacgtatgtcacgaccggtgctcgatttagtgtagtgtgaagggaaggggggagaggagcccagcactgggattccgaggtgtttccattcggtgatcagcactgaacacagaggactcaccatggagttttggctgagctgggttttccttgttgctatttaaaaggtgtccagtgtgaggtgcagctggtggatcgtggaggaggctgaagcagcctggggggtccctgagactctcctgtcncgagcctcgtgggttcaccgtcaggtacacaactacatgagcgtggtcccgccgaggcctcgagggaacggggccggaggtcgggtcncgtagttattagnggggtacgttagaaaccgttacacgttaccgtacggacaacggtaccgttaccgggaggaaacggggacccgtatttacccggaaaacccgtctttaccctacccggaaaggacggtaaccccctaaaggtttaccccggaaaaagtaaaccccgttaccgtagtttaccgttaccccgttaacgtttaaccaaaaagtttcgaaaaccgtcgtacccgttaaggacgtaacgggcccgaaggtaacccgagggtcccgttaagttaacttacgtcgtaggacgtaggacgttaccgagggtaaaccgtgggttacctaaccggttgtacctaagtttcgggaaccttacgggtccgggaccgaccgggtaacccgg

SEQ ID NO: 200101 - DNA, 619 bp, Homo sapiens
  misc_feature: GYAE6OF02JO99E.42.70.G04.1.454.CMB.1.raw
  modified_base (260)..(260): a, c, t, g, unknown or other
  misc_feature (260)..(260): n is a, c, g, or t
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
tcagtgacgtatgtcacgaccggtgctcgatttagtgtagtgtgaagggaaagggggggaggaggagcccagcactgggattccgaggtgtttccattcggtgatcagcactgaacacagaggactcaccatggagttttggctgagctgggttttccttgttgctatttaaaaggtgtccagtgtgaggtgcgagctggtggagtcgtggaggaggcttggaagcagccgtggggggtccctgagactctcctgtcgcngcctcgtgggttccaccgtcacgtgcaactanatgagcgtcggtccgccgaggcctccggagggacggggccggagtcgggtctcgagtttagttacgngggtccggtagaaaccgtatagtacctacgccaggacctccggtaggaaccgggtccgacttaccgaacctataccgtaccgagtaacgacctaacgttacgaaacgaacacgtacgttctacgttactacgaaactagaacacgtcgtagacgacgcgagaccgacggtcgtagtacgtctcgngcgtagngtaccgtaggaacggtgtacgtagttcgcttagtttacggacttcgggtacggaccgtacggtacccg

SEQ ID NO: 200102 - DNA, 741 bp, Homo sapiens
  misc_feature: GYAE6OF02GP4ZP.42.70.G04.1.454.CMB.1.raw
  modified_base (563)..(563): a, c, t, g, unknown or other
  misc_feature (563)..(563): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctgggtggagtctgggaggaggcttgaagcagccgtggggggtccctgagactctcctgtcgcacgcctcgttcggttccacccgtcaagtacgacaactacagtgagtcgtgggtcccgcgacggctaccggaggggaacggggccgggaggttcgggtctcgtaagtttagtttagtcgggtacggtagaaactactaacgtaaccgtaacgacgaacggaccgttaccggtagggaaacggggcccgtaacgttaccaaacccgtacgttacccaccgtaacggaaccgtaaccctaacgttaaccggaaaacgtaaacctaacgttactttcggtacccttactttaacgaaaagttcgaaacncgtaccgtagacggtacgaccggaacggaccgaccggggtccgttagttaaccgttacgtggtacggacgtaacggtacggttacgtaacgggtaaagtccggttaccgttaacggtttgaccgtttagtttaccggaccgttaaccgggaccggggtaccgaacccggggtaccccg

SEQ ID NO: 200103 - DNA, 653 bp, Homo sapiens
  misc_feature: GYAE6OF02G9IPF.42.70.G04.1.454.CMB.1.raw
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctgggaggaggcttgaagtcagcctgggggtccctgagactctcctgtgcagcctcgtggttccaccggtacagtagcaactacatgacgctcgggtcccgccgaggcctaccggaggggaacggggccgggaggtcgggtcgtcgtaaggtttagtttagtgggtcggttagaaactacgaattacctacggcaagacgtaccggagggaacgggccgagttacaccatcctaccaggacgacctaagttaccgaaagaaccgatacttgtaccttacttaacaaagtcgaaacagcccgtaggaactacggcccgaagggaccaccggggtccttgtaacttccggtgtcggagtaggacggttcgtaacggaaaggtcggacttacggtgtaccttaaggttttccaaccggttacggtcgggggtaccctaggggtaaccccg

SEQ ID NO: 200104 - DNA, 737 bp, Homo sapiens
  misc_feature: GYAE6OF02HCUPR.42.70.G04.1.454.CMB.1.raw
  modified_base (570)..(570): a, c, t, g, unknown or other
  misc_feature (570)..(570): n is a, c, g, or t
  modified_base (587)..(587): a, c, t, g, unknown or other
  misc_feature (587)..(587): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgtctattttaaaaggtgtccagtgtgaggtgcagcgtgggtggtagtcgtagggaggaggtcgttaggaacgcgacggtcccggttcggggggggttcccctaggaacggtaccttcctcccgttggtcgaccgacggtccccgttcgttcggggttaccctaccggtacgtaacggtaacgacctaaacgtaaccagttggaggtccggtcggggtcccgcccggacggcccgtaccgggaagggggaacgggggtccgggtaggttcgggttcctacgtaagtttatttaggtcgggtacggtacgaaaccttactaacgtaaccgtacgacgtacgtaccgtacggtaggaacggtaccgtactaccacctactaccaccgaagacgtaacctaggtacgaaanactagtattcgtacttntaaacgaatacgaactcgtacctggaacgcgaccgaggacgacgggtacttagttacttcaggtcgacggtagtcggtactaggacggttacgcttacggtgtaacttggttacgacccgttgggtaaccgggacctaacgggtaccccg

SEQ ID NO: 200105 - DNA, 837 bp, Homo sapiens
  misc_feature: GYAE6OF02JFL51.42.70.G04.1.454.CMB.1.raw
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagcgttgggttttccttgttgtcttaattttaaaaggtgtccagtgtgaggtgcagctgggtggagtcgtggaggaggtcttaggaagcgacggtccggttcggggggttccctggtacggtaccgttccttccgttggtcggccgtacggtcccgttcgttcgggtttccgtacccgtcgtaacggtagaccgtaaactacgtaatggacgtcggttccggggtcccgccggtaacggtccgtaccgggaacgggggaacgggggaccgggtaggttcgggttccttacgttaagttttagttaggttcggggtaccggttaacgaaaccgttactaacgtaaccgtacgtacgaacgtcccgttaccggtaagggaaccgggtaccgtaacgttccaaacctacgtccctaaccgaagggaaccctaaccgtttaacggttaaaccggaaaactaacccgtaacgttacgttaccggttacttacgttaaacaaagttacgaaaccgtaccgtcgacggaaacggccgaccggtaacgaacccggacgttccgggtatttaacgtttacgagggttacgacgttaacggtacgtaacggtaacggttaaacggtcggttaccgttacggttacgtaccttaaggttaccggaacgttacccgggggtacggaccggtaaacccgggtccg

SEQ ID NO: 200106 - DNA, 874 bp, Homo sapiens
  misc_feature: GYAE6OF02JKV54.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagtcttgggttttccttgttgacttattttaaaggtgtcctagtgtgaggtgcagcgtggtggtacgtcgtggaggacggtcgttagaagcgacggccgtcgggggtccctgacgtactccgtcctgtcgccgtacgtcctcgttggtaccgtaccggtacgtaacggttacggacctaacgtaaccgtagtacggtacgtccggttaccggggtacccgtcccgtacgggtcccgttaacccggggaaacggggggtaaccgggggtacccgggtaacggggttacgggttccgttaacgggttaaacggtttttacgtttacgggttaccggggttaacgggttaaaccggtaaaacctaacggttaacttaaccggttaccggaaccgtaacggtacccggtacccggttaagggtaaaccggtacccggttactacccgtaacccgtaaccgttacctaccgaaggtaccgtaaacccgttagttaaccggaaactaaaccgtacttaccgttaacgttaccttaaccgtaaataaacggtccgaaacgttacgccgttaacgaccggtaacgacccgggaaaggtaccgacccgggtaccgtttaacgttgttaaccggttggtacgaccgggttagtacccgtttgaaaccggtaaggtccgttaagtccgttgtaacgttcgttacgtaccggtacggtcccgggtaccggacggttaccccg

SEQ ID NO: 200107 - DNA, 741 bp, Homo sapiens
  misc_feature: GYAE6OF02G3XVM.42.70.G04.1.454.CMB.1.raw
  modified_base (146)..(146): a, c, t, g, unknown or other
  misc_feature (146)..(146): n is a, c, g, or t
  modified_base (626)..(626): a, c, t, g, unknown or other
  misc_feature (626)..(626): n is a, c, g, or t
tcagtgacgtatgtcacgaccggtgctcgatttagtgtagtgtgaaggggaaagggggggagaggagcccagcactgggattccgaggttgtttccattcggtgatcagcactgaacacagaggactcaccatggtagtttgctgngtcgttgggttttccttgttgacttaattttaaaaggtgtcctagtgtgaggtgcagcgtggggtgggtcgtgggaggaggtactaaagcacggccggtcgggggtcctgacgtacttcctcctgtgacacgtccgtcgtcggtcctaccgtcgactacgactaactacatgagcgtccgggtccaccgacgcgtaccgggaaggggacggggcggtaggtcgggtacctagtagtttagttaggtgggacggtaactaaacgttacacttaacgtaccgactaacggtaccgtaccggtaacgggtaacggtccgtaaacttaccaacgtacctacccgtaacgaacggtaacctaaacccggtaacttaacggaaaccgtaaccctagttacgttccgttacttaactaacgaaattacgacgacgtcgaggacgacgtaccggaacgaccgtaccggtacgtttaatccttaacggngtcgaaacgacgtaggttaaccgaaggtacgtacgggtcgttaactggtacctttaggttaaccggccgttacgggtaccggtacccggtaacgggtacccctaccggttacccg

SEQ ID NO: 200108 - DNA, 781 bp, Homo sapiens
  misc_feature: GYAE6OF02H7WQ1.42.70.G04.1.454.CMB.1.raw
  modified_base (351)..(351): a, c, t, g, unknown or other
  misc_feature (351)..(351): n is a, c, g, or t
  modified_base (669)..(669): a, c, t, g, unknown or other
  misc_feature (669)..(669): n is a, c, g, or t
tcagtgacgtatgtcacgaccggtgctcgatttagtgtagtgtgaagggaaaggggggagaggagcccagcactggattccgaggtgtttccattcggtgatcagcactgaacacagaggactcaccatggagttttggctgagcgtggtttttccttgttgtactatttttaaaaggtgtacctagtgtgaggtgcagcgtggtggagtcgtggaggaggcgttgaagcgaggccggtcggggggttccctggagtaccgtacctccgtcgtgccacgtccgtcgttacgggttccaccggtcgtaacgtacgtacctaaacgtaacctagtgaacgtcgtcgggtcccncccggtaacgtccgtaccggaagggacggggtaccggaggttcggttcgtacgttaacgtttaagtttacggtcggtacgggtaacgtaaaccgttaactaacgttacgtaccgcgtaacgtaccgttacggacggtaacggtccgtaacttccgacccttaggttacccctacggtaacgtacgaacccgttaagttaaccgaaacgaactaaccgtagttacggttaccttacgttaaccgtaaacttacgaaccacgtaccgagtaacggaccgtacggacgaaccggtcgaccggttagttaacttacgtcggngtaacgtacgtacgttacggtaacgaaccggttaggttaacttaccggttacggtaccgtttagttcgtaaccggttttacggacccgggtacccgttaccgggttaacccg

SEQ ID NO: 200109 - DNA, 815 bp, Homo sapiens
  misc_feature: GYAE6OF02HZPUP.42.70.G04.1.454.CMB.1.raw
tcagtgacgtatgtcacgaccggtgctcgatttagtgtagtgtgaagggaaaggggggagaggagcccagcactgggattccgaggtgtttccattcggtgatcagcactgaacacagaggactcaccatggtagttttggctgagtcgttgggtttttccttgttgtcttaagttttaaaaggtcgtcctagttgtgaggtgcgagcgtgggtggtacgtcgttgggaggtggtcgttaggaagtcgacggtcccggtcgggggttcccgtaggacgtacctccgtccgtggtcgcgtacgtccgtgttcgggtaccaccggtcgacgtacgtacaactagatcgtaggtcggttcggcccgaccgacggtcgtaccggaggggacgggtccggtaggttcggtccgttagttaacgtttagtttacggtacggtacggtaacgtaaacgtacgtaacgttaaccctaacggtcgtaacggttacccgtacggtaacggacggggttaccctaacgtttacccaaccgtacgttacccgtaccgtaaacggtaaccgtaaccgtaacgttaaacgaaaccgtaaacgtacctaacgtttacgtacccgttaacgttaaaccgtaaacgttacgaaccgtacggtaaccgttaggaacccggtaacgtacccgggaacgtaaccgggtacccgggtccgttaagtttaccgtaaccttggacgtacggtgtacgtccggtaacggtaaggtcgttacgtacgttcgtcgtaacgttacgtaccgttaccggtacggacccggttaaggtacccgg

SEQ ID NO: 200110 - DNA, 828 bp, Homo sapiens
  misc_feature: GYAE6OF02IDRDY.42.70.G04.1.454.CMB.1.raw
  modified_base (307)..(307): a, c, t, g, unknown or other
  misc_feature (307)..(307): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagagactcaccagtggtagtttggctgagtcgtttgggttttccttgttgcttaagttttaaaaggtgtcctagtgtggaggtgcagtcgtgggtaggagtcgtaggggagggacggtcgttaggaacgcggtacggtccgggtccggggggtaccctagggacgtaccgttccgtccgttggtccgacnccggtccgttcggtttccgggttccctaaccggtaccgtaaggttaaccggactaaaaccgttacgaagtcggacggtacggttccggggacccgtacccggaggttacccgtaaccggggaacgggggtaaacgggccgggttaacggtacggggttaccttacgtaagttttagtttacggtcgggtaacggtaagtaaacctagtaacctacgtacgtacgagtaaccgtcgaggacgggtactacgtaccaacgtctccacgtaacgacgtaacctaaggtaacaaagtacacttacgttcttaacctaccgttaataaacgtacgaaacgtaccgacgttacggacggtaaccgaccgggaacgtccggtaacccgtgtaacgttacttacgtacggcggaacgttaacgacgggtttaacgaacggttaacggtacggttaacgttgtaccgtacgtttacgttaccggtaccggttaagggtaccggacccggggttaacccgttaacccgggg

SEQ ID NO: 200111 - DNA, 799 bp, Homo sapiens
  misc_feature: GYAE6OF02IECIL.42.70.G04.1.454.CMB.1.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
  modified_base (724)..(724): a, c, t, g, unknown or other
  misc_feature (724)..(724): n is a, c, g, or t
tcagtgacgtatgtcacgaccggtgctcgatttagtgtagtgtgaagggaaaggggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctgggaggaggcgttagaagnagccgtggggggtccctgacgactcgtcctgtagcagccgttcgtggggttaccaccggtnaacgtagccaaactacaagtcgagtcgtcgggtcccgaccgaaggtcctacggaagggggtaaacggggccggtaaggtcgggtcctacgtaaggtttaagtttacgagggtacggtaacgtaaaaccgttactaacttaaccgtacggtaacgaagtaaccccgttacggtacggaaaccgggggccctaatttaacccgaaccgtattacccgtaccgaaggtacaacccggtaatttaaccggaaagtaaacctaacaactttagtacccttagtttaaaccaaaagtacgtaaacccaggtccctaaggaacggaacgaccggttaaaggacccggaacgggtccgttaattaccgtttaaccgtggtaagggtcgtaaggaccgggttaaccgttacgggtaaaggttcggaaccctttaaaccgggtttnaaccggttttaacttacggggtaaaccccgtttaaagggcccggggggtacccgaaacgggggtttaacccccgg

SEQ ID NO: 200112 - DNA, 838 bp, Homo sapiens
  misc_feature: GYAE6OF02GT4GF.42.70.G04.1.454.CMB.1.raw
  modified_base (674)..(674): a, c, t, g, unknown or other
  misc_feature (674)..(674): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagagactcaccatgagttttggctgagtcgttcggttttccttgttgtacttaattttaaaaggtcgtccagtgtggaggtgcagcgtggtggtacgttcgtagggaggtaggtcgttagaacggcgacggccgggttcggggggttccctaggacgtaccttcctccgtgtcgaccacgtcccgttcggttcggggttcccaccggttacgtaggttacgacctaacgttaacgtacgtacggacgtccgggtaccggggtacccgtacccgggacgggtcccgtaccggggaacggggggaccggggtccgggtagggtccgggttacgttacgttaaggtttttagttaggttcggggtaaccggttaacgtaaaccgttaacctaacgttaccgtaccgacgtaacggtacccgtacggtagggaaccggtaccgtacttccgaaccgtcgtaccgtacggacgtaacccgtacttaacgttaaacggaactaacgtcgttaggttccttaccttataacgaaacgtctaaccgagtcgtaggaggtacccgnggtaaccggcgtaaccggtgttaagtttaccgtagtcggtaacggacgttaaggttcccggtagtaaccgggtaacggttcggtaaccctttgggttacctaaggtttttacccgttacgggaccggtttaccgggggacggttacccggaaacggtttcccgg

SEQ ID NO: 200113 - DNA, 740 bp, Homo sapiens
  misc_feature: GYAE6OF02IMAL1.42.70.G04.1.454.CMB.1.raw
  modified_base (413)..(413): a, c, t, g, unknown or other
  misc_feature (413)..(413): n is a, c, g, or t
tcagtgacgtatgtcacgaccggtgctcgatttagtgtagtgtgaagggaaagggggggggagaggagcccagcactgggattccgaggtgtttccattcggtgatcagcactgaacacagaggactcaccatggagttttggctgagctgggttttccttgttgcttaattttaaaaggtgtccagtgtgaggtgcagtctggtggtagtctagggaggagcgttagaacgcacggccggttcgggggggtaccctggtacgtactcgtaccgtggttcgacgacgtccttcgtcggttaccgaccgttacgagtacgacaactacagtgacgtcgtcgggtccgccgacggtcctaccggtaaggggaaccggggtcggacggttcggtctacgtaagtttaagtttacgngggtacgggtaacaaaccgtactaacgtaactaaccggcgtaaggtacccgttacggtaagggtaaaccggtccgtaacttaccgacccgtattaccgtaccaagtaacgaacctaacggttaacgaaacgaactactacgttagtacctacttaaacaaactagaacctaacgtctaggaacgtccggaccggtaaggacccgacgtcggttacgtacttacggtgtcgacggttaacggcgtaacgtacggtaacggtcggttacgtaccggttgtacttcgttacggtaccggttacggtcgggtacccggaacggtacccggg

SEQ ID NO: 200114 - DNA, 742 bp, Homo sapiens
  misc_feature: GYAE6OF02FXUZ6.42.70.G04.1.454.CMB.1.raw
  modified_base (564)..(564): a, c, t, g, unknown or other
  misc_feature (564)..(564): n is a, c, g, or t
tcagtgacgtatgtcacgaccggtgctcgatttagtgtagtgtgaagggaaagggggggagaggagcccagcactgggattccgaggtgtttccattcggtgatcagcactgaacacagaggactcaccatggtagtttggctgagcgttgggttttccttgttgcttaagttttaaaaggtgtaccagtgtgaggtgcagtcgtggtggagttcgtgggaggaggtcttagaagtcacggccggtcgggggtccctgacgtctctaccgtgtgccacgccttcgttcggttcaccgtacagtacgactaactacagtcgacgtccggtcgggtccgtaccggtacgccgtaccgggaaggggggtaccgggggccgggtaggttcgggtctaacgttaggttttaacgttacggtcggtacggtaacgtaaaccttactaaccgtaccgtacgacgtaacgaccgtacggtaggacgggtcctactccctaccgtactaccgaccgaagaccgtaacgtactaaaccggaaactaacgaacttcgttacgtccttaccttaanaaacttacgaactcgcgtagaacggaccgtacggaccggaacgtccgggaccgttattacgttaacgtcggtaacgcgaacgggttaggtactacggtaaaggtctaacgggtttagtaacgttacgtacgttttcggaaccggttaccgggtacgggtacccggtaacggtacccgg

SEQ ID NO: 200115 - DNA, 739 bp, Homo sapiens
  misc_feature: GYAE6OF02GFKM3.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggtagttttggctgagctgggttttccttgttgcttattttaaaaggtgtccagtgtgaggtgcagctggtggagtcgtggaggaggcttgaagcaggccgtcggggggtccctgagactctccgtgtgcacgcctcgtgggttccaccgtgagtacgacaactacatgagcgtcggtccgccgaggctccggaggggaacggggccggaggtcgggtctacgtagtttattagtcgggcggttacgaaactacaatactacgacacgtacgtcggtaggaacgggccgtatccaactactcctaccgaagaccgaacctagttaccggaaaagaaccacgtaagtttgaccctttaccttaaactaaaagtcggaaaaccacgtacccgtagaaaccggacggacccgggtaagggaccccgtaaccggggtccggttaagttaaaccgttttacgaggttaccggacggtaagggtaccggttaccgtaaccggggttaaaggttccgggttaacctttaaccgggtttacgacgtttaaaccggttttacggaacccggttttaccggggtacggggggtaacccaacccgggggttaacccccg

SEQ ID NO: 200116 - DNA, 720 bp, Homo sapiens
  misc_feature: GYAE6OF02GJPKH.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagcttgggttttccttgttgcttattttaaaaggtgtccagtgtgaggtgcagctggtggagtctggaggaggcttgaagcagccgtgggggtccctgagacctctcctgtcgcacgcctcgtgggttccaccgtcagtacgacaactacatgacggtctcgggtcccgccaggccgtaccgacgggggaacggggccggaggtgggtctcgtaagtttattacgtggcggtagaaactactactaacctacgacagtaccgtccggtaggaacgggcctactaccaaccctactaccgtaccaaggaccgtaaccctaagttacgaaacgaacctacgtatttcgtacctttactaacctaaagtaaccgaacctcgtactagggacgtaacggccccggaacgggacccggaaccgggtacccgtttagtttaaacctttacggacggttacggacgggttaacgtacgggttacctaaccggggtaaaggttcggtacccgtttaacgggtcgtcctttaaaggtttccggaaccgttaccgggtaccggggtaccccgaggggtaaccccgg

SEQ ID NO: 200117 - DNA, 679 bp, Homo sapiens
  misc_feature: GYAE6OF02HNXFO.42.70.G04.1.454.CMB.1.raw
tcagtgacgtatgtcacgaccggtgctcgatttagtgtagtgtgaagggaaagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtggagtctgggaggaggcttggaagcagccgtgggggtccctgagactctcctgtgcagcctctcgggttcaccgttcagtagcctaactacattgacgtcgtacgggtccgcccgacggctacccggaaggggaacggggcccgggtaggtcgggtcttacgtaagtttacgtttagtcgggtacggttacgtaaacctaacgtacttaccgtaacgcctaacggtacctaccggtacggaacgggcccgtaacttccaaccacgttccctacgaagtacgtaccagttacgaaagaacctatagtttctcctactttacaaactgaaacgtacgccgtagacgacggcccgtaagggaccacgggtcccggtagttacgttacgtcgtcggacgaggtaccggtcgtaacggtaaaggtcggtaccttacggttgccttagttacgtacgttacggacggggtaccacgggtaacccg

SEQ ID NO: 200118 - DNA, 829 bp, Homo sapiens
  misc_feature: GYAE6OF02FK33L.42.70.G04.1.454.CMB.1.raw
  modified_base (235)..(235): a, c, t, g, unknown or other
  misc_feature (235)..(235): n is a, c, g, or t
tcagtgacgtatgtcacgaccggtgctcgatttagtgtagtgtgaagggaaaggggggagaggagcccagcactgggattccgaggtgtttccattcggtgatcagcactgaacacagaggactcaccatggtagttttggctgagcgttgggtttttcctttgttcgacttaaagtttttaaaaacggtgttccgaagttgtggtagggtgacagcgttgggtaggagttacgngggtaggaggtcgttagaagcacgtccggtcgggggtccctgacacgtcctccgtgtcgacgcgtccgttcgtcggttaccgaccgttactaacggtacaacctaaacctaccgtagttaggaccgtccggttccgggtccccgtaccgaggcccgtacccgggaaggggtaacgggggtaccggaggttgggtaaccgtgttaacgttttagttaggtcggtaacggtaataaaacccgtactaacgttaaccgtaccgacgtaaccggtaacccgttccgggtaaggtaaccgggacccgtacttacccggaacctacctaccctaacgtaacgtacgaacttacgttaaccggaaacgaaacctaaccttacgttaccttacgtaccctttaaaccgtaaacgtacgtaacgaaccgtaccttacggaacgtacggaccggtaaaccggaccggaccggttaccggttagttaaccgttacgaggtaacgcggtaacggtacggttaccggtaaggtaaacggtacgtaacgttgttacgagtttaccggttacgtacgtaaccggtaccggtaccggtacggtaacccgg

SEQ ID NO: 200119 - DNA, 170 bp, Homo sapiens
  misc_feature: GYAE6OF01BTX9D.37.86.H09.1.454.CMB.1.raw
  modified_base (170)..(170): a, c, t, g, unknown or other
  misc_feature (170)..(170): n is a, c, g, or t
tcagtagtgtagatcacgaccggtgctcgatttagtgctatagacttgggtttgggaagaggaagactgacggtccccaggagttcaggtgctgggcacagcggccctgggctgcctggtcaaggactacttccatctacactactgagcgggctggcaaggcgcatagn

SEQ ID NO: 200120 - DNA, 171 bp, Homo sapiens
  misc_feature: GYAE6OF01DU1D2.37.86.H09.1.454.CMB.1.raw
  modified_base (170)..(171): a, c, t, g, unknown or other
  misc_feature (170)..(171): n is a, c, g, or t
tcagtagtgtagatcacgaccggtgctcgatttagtgctatagacttgggtttgggaagaggaagactgacggtccccaggagttcaggtgctgggcacagcggccctgggctgcctggtcaaggactacttccatctacactactgagcgggctggcaaggcgcatagnn

SEQ ID NO: 200121 - DNA, 171 bp, Homo sapiens
  misc_feature: GYAE6OF01BI5HR.37.86.H09.1.454.CMB.1.raw
  modified_base (171)..(171): a, c, t, g, unknown or other
  misc_feature (171)..(171): n is a, c, g, or t
tcagtagtgtagatcacgaccggtgctcgatttagtgctatagacttgggtttggggaagaggaagactgacggtccccaggagttcaggtgctgggcacagcggccctgggctgcctggtcaaggactacttccatctacactactgagcgggctggcaaggcgcatagn

SEQ ID NO: 200122 - DNA, 172 bp, Homo sapiens
  misc_feature: GYAE6OF01CZJFT.37.86.H09.1.454.CMB.1.raw
  modified_base (172)..(172): a, c, t, g, unknown or other
  misc_feature (172)..(172): n is a, c, g, or t
tcagtagtgtagatcacgaccggtgctcgatttagtgctatagacttgggtttgggggaagaggaagactgacggtccccaggagttcaggtgctgggcacagcggccctgggctgcctggtcaaggactacttccatctacactactgagcgggctggcaaggcgcatagn

SEQ ID NO: 200123 - DNA, 171 bp, Homo sapiens; identical to SEQ ID NO: 200121
  misc_feature: GYAE6OF01EJFZ5.37.86.H09.1.454.CMB.1.raw
  modified_base (171)..(171): a, c, t, g, unknown or other
  misc_feature (171)..(171): n is a, c, g, or t

SEQ ID NO: 200124 - DNA, 207 bp, Homo sapiens
  misc_feature: GYAE6OF01ENHIU.37.86.H09.1.454.CMB.1.raw
  modified_base (174)..(207): a, c, t, g, unknown or other
  misc_feature (174)..(207): n is a, c, g, or t
tcagtagtgtagatcacgaccggtgctcgatttagtgctatagacttgggttggggaagaggagactgacggtcccctaggagttcaggtgctgggcacagcggcctgggctgcctaggtctaaggctacttccatctacactacgtgagccgggctggcaaggtcgcagtagnnnnnnnnnnnnnnnnnnnnnnnnnnnnnnnnnn

SEQ ID NO: 200125 - DNA, 172 bp, Homo sapiens
  misc_feature: GYAE6OF01BMNXG.37.86.H09.1.454.CMB.1.raw
  modified_base (171)..(172): a, c, t, g, unknown or other
  misc_feature (171)..(172): n is a, c, g, or t
tcagtagtgtagatcacgaccggtgctcgatttagtgctatagacttgggtttggggaagaggaagactgacggtccccaggagttcaggtgctgggcacagcggccctgggctgcctggtcaaggactacttccatctacactactgagcgggctggcaaggcgcatagnn

SEQ ID NO: 200126 - DNA, 171 bp, Homo sapiens; identical to SEQ ID NO: 200121
  misc_feature: GYAE6OF01BT3SY.37.86.H09.1.454.CMB.1.raw
  modified_base (171)..(171): a, c, t, g, unknown or other
  misc_feature (171)..(171): n is a, c, g, or t

SEQ ID NO: 200127 - DNA, 173 bp, Homo sapiens
  misc_feature: GYAE6OF01B2ULH.37.86.H09.1.454.CMB.1.raw
  modified_base (173)..(173): a, c, t, g, unknown or other
  misc_feature (173)..(173): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagn

SEQ ID NO: 200128 - DNA, 174 bp, Homo sapiens
  misc_feature: GYAE6OF01DT190.37.86.H09.1.454.CMB.1.raw
  modified_base (173)..(174): a, c, t, g, unknown or other
  misc_feature (173)..(174): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnn

SEQ ID NO: 200129 - DNA, 255 bp, Homo sapiens
  misc_feature: GYAE6OF01CSOPV.37.86.H09.1.454.CMB.1.raw
  modified_base (254)..(255): a, c, t, g, unknown or other
  misc_feature (254)..(255): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccatctacactactgagcgggctggcaaggcgcatagnn

SEQ ID NO: 200130 - DNA, 173 bp, Homo sapiens; identical to SEQ ID NO: 200127
  misc_feature: GYAE6OF01B2CM6.37.86.H09.1.454.CMB.1.raw
  modified_base (173)..(173): a, c, t, g, unknown or other
  misc_feature (173)..(173): n is a, c, g, or t

SEQ ID NO: 200131 - DNA, 173 bp, Homo sapiens; identical to SEQ ID NO: 200127
  misc_feature: GYAE6OF01ESPU3.37.86.H09.1.454.CMB.1.raw
  modified_base (173)..(173): a, c, t, g, unknown or other
  misc_feature (173)..(173): n is a, c, g, or t

SEQ ID NO: 200132 - DNA, 172 bp, Homo sapiens; identical to SEQ ID NO: 200122
  misc_feature: GYAE6OF01BVD10.37.86.H09.1.454.CMB.1.raw
  modified_base (172)..(172): a, c, t, g, unknown or other
  misc_feature (172)..(172): n is a, c, g, or t

SEQ ID NO: 200133 - DNA, 177 bp, Homo sapiens
  misc_feature: GYAE6OF01AW51M.37.86.H09.1.454.CMB.1.raw
  modified_base (172)..(177): a, c, t, g, unknown or other
  misc_feature (172)..(177): n is a, c, g, or t
tcagtagtgtagatcacgaccggtgctcgatttagtgctatagacttgggtttggggaagaggaagacgtgacggtccccaggagttcaggtgctgggcacagcggccctgggctgcctggtcaaggactacttccatctacactactgagcgggctggcaaggcgcatagnnnnnn

SEQ ID NO: 200134 - DNA, 184 bp, Homo sapiens
  misc_feature: GYAE6OF01AQA97.37.86.H09.1.454.CMB.1.raw
  modified_base (172)..(184): a, c, t, g, unknown or other
  misc_feature (172)..(184): n is a, c, g, or t
tcagtagtgtagatcacgaccggtgctcgatttagtgctatagacttgggtttggggaagaggaagactgacggtccccaggagttcaggtgctgggcacagcggccctgggctgcctggtcaaggactacttccatctacactactgagcgggctggcaaggtcgcatagnnnnnnnnnnnnn

SEQ ID NO: 200135 - DNA, 183 bp, Homo sapiens
  misc_feature: GYAE6OF01DF7YZ.37.86.H09.1.454.CMB.1.raw
  modified_base (173)..(183): a, c, t, g, unknown or other
  misc_feature (173)..(183): n is a, c, g, or t
tcagtagtgtagatcacgaccggtgctcgatttagtgctatagacttgggtttgggggaagaggaagaatgacggtcccccaggagttcaggtgctgggcacagcggccctgggctgcctggtcaaggactacttccatctacactactgagcgggctggcaaggcgcatagnnnnnnnnnnn

SEQ ID NO: 200136 - DNA, 229 bp, Homo sapiens
  misc_feature: GYAE6OF01ASFG4.37.86.H09.1.454.CMB.1.raw
  modified_base (177)..(229): a, c, t, g, unknown or other
  misc_feature (177)..(229): n is a, c, g, or t
tcagtagtgtagatcacgaccggtgctcgatttagtgctatagacttggggtttggggggaagagggaagactgacggtcccccaggagttcaggtgctgggcacagcggccctgggctgcctggtcaaggctacttccatctacactactgagcgggcttgggcaaggcgcatagnnnnnnnnnnnnnnnnnnnnnnnnnnnnnnnnnnnnnnnnnnnnnnnnnnnnn

SEQ ID NO: 200137 - DNA, 173 bp, Homo sapiens; identical to SEQ ID NO: 200127
  misc_feature: GYAE6OF01EONBZ.37.86.H09.1.454.CMB.1.raw
  modified_base (173)..(173): a, c, t, g, unknown or other
  misc_feature (173)..(173): n is a, c, g, or t

SEQ ID NO: 200138 - DNA, 188 bp, Homo sapiens
  misc_feature: GYAE6OF01BK6HS.37.86.H09.1.454.CMB.1.raw
  modified_base (173)..(188): a, c, t, g, unknown or other
  misc_feature (173)..(188): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnnnnnnnnnnnnnnnn

SEQ ID NO: 200139 - DNA, 173 bp, Homo sapiens; identical to SEQ ID NO: 200127
  misc_feature: GYAE6OF01AE5MI.37.86.H09.1.454.CMB.1.raw
  modified_base (173)..(173): a, c, t, g, unknown or other
  misc_feature (173)..(173): n is a, c, g, or t

SEQ ID NO: 200140 - DNA, 173 bp, Homo sapiens; identical to SEQ ID NO: 200127
  misc_feature: GYAE6OF01EBXAH.37.86.H09.1.454.CMB.1.raw
  modified_base (173)..(173): a, c, t, g, unknown or other
  misc_feature (173)..(173): n is a, c, g, or t

SEQ ID NO: 200141 - DNA, 172 bp, Homo sapiens; identical to SEQ ID NO: 200125
  misc_feature: GYAE6OF01ATI7D.37.86.H09.1.454.CMB.1.raw
  modified_base (171)..(172): a, c, t, g, unknown or other
  misc_feature (171)..(172): n is a, c, g, or t

SEQ ID NO: 200142 - DNA, 173 bp, Homo sapiens; identical to SEQ ID NO: 200127
  misc_feature: GYAE6OF01BZ35G.37.86.H09.1.454.CMB.1.raw
  modified_base (173)..(173): a, c, t, g, unknown or other
  misc_feature (173)..(173): n is a, c, g, or t

SEQ ID NO: 200143 - DNA, 172 bp, Homo sapiens
  misc_feature: GYAE6OF01DDW12.37.86.H09.1.454.CMB.1.raw
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatag

SEQ ID NO: 200144 - DNA, 174 bp, Homo sapiens; identical to SEQ ID NO: 200128
  misc_feature: GYAE6OF01EL5RO.37.86.H09.1.454.CMB.1.raw
  modified_base (173)..(174): a, c, t, g, unknown or other
  misc_feature (173)..(174): n is a, c, g, or t

SEQ ID NO: 200145 - DNA, 164 bp, Homo sapiens
  misc_feature: GYAE6OF01AEWWK.37.86.H09.1.454.CMB.1.raw
  modified_base (113)..(113): a, c, t, g, unknown or other
  misc_feature (113)..(113): n is a, c, g, or t
  modified_base (135)..(164): a, c, t, g, unknown or other
  misc_feature (135)..(164): n is a, c, g, or t
tcagtagtgtagatcacgaccggtgctcgatttagtgctatagacttgggtttgggcacagccggccctgggctgcctggtcaagggactacttccagtcctacactactgancgggctggccaaggcgcatagnnnnnnnnnnnnnnnnnnnnnnnnnnnnnn

SEQ ID NO: 200146 - DNA, 185 bp, Homo sapiens
  misc_feature: GYAE6OF01CGH0D.37.86.H09.1.454.CMB.1.raw
  modified_base (174)..(185): a, c, t, g, unknown or other
  misc_feature (174)..(185): n is a, c, g, or t
tcagtagtgtagatcacgaccggtgctcgatttagtgctatagacttgggtttggggggaagaggaagactgacggtcccccaggagttcaggtgctgggcacagcggccctgggctgcctggtcaaggactacttccatctacactactgagcgggctggcaaggcgcatagnnnnnnnnnnnn

SEQ ID NO: 200147 - DNA, 168 bp, Homo sapiens
  misc_feature: GYAE6OF01B0A4G.37.86.H09.1.454.CMB.1.raw
  modified_base (168)..(168): a, c, t, g, unknown or other
  misc_feature (168)..(168): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactcatctacactactgagcgggctggcaaggcgcatagn

SEQ ID NO: 200148 - DNA, 172 bp, Homo sapiens
  misc_feature: GYAE6OF01B42M6.37.86.H09.1.454.CMB.1.raw
  modified_base (172)..(172): a, c, t, g, unknown or other
  misc_feature (172)..(172): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactactccatctacactactgagcgggctggcaaggcgcatagn

SEQ ID NO: 200149 - DNA, 173 bp, Homo sapiens; identical to SEQ ID NO: 200127
  misc_feature: GYAE6OF01EQZW1.37.86.H09.1.454.CMB.1.raw
  modified_base (173)..(173): a, c, t, g, unknown or other
  misc_feature (173)..(173): n is a, c, g, or t

SEQ ID NO: 200150 - DNA, 173 bp, Homo sapiens; identical to SEQ ID NO: 200127
  misc_feature: GYAE6OF01CD2UM.37.86.H09.1.454.CMB.1.raw
  modified_base (173)..(173): a, c, t, g, unknown or other
  misc_feature (173)..(173): n is a, c, g, or t

SEQ ID NO: 200151 - DNA, 202 bp, Homo sapiens
  misc_feature: GYAE6OF01EOWFM.37.86.H09.1.454.CMB.1.raw
  modified_base (174)..(202): a, c, t, g, unknown or other
  misc_feature (174)..(202): n is a, c, g, or t
tcagtagtgtagatcacgaccggtgctcgatttagtgctatagacttgggtttgggggaagaggaagactgacggtcccccaggagttcagggtcgctgggcacagcggccctgggctgcctgtcaaggctacttccatctacatactgagcgggctgggcaaggcgcattagnnnnnnnnnnnnnnnnnnnnnnnnnnnnn

SEQ ID NO: 200152 - DNA, 209 bp, Homo sapiens
  misc_feature: GYAE6OF01CAY7O.37.86.H09.1.454.CMB.1.raw
  modified_base (174)..(209): a, c, t, g, unknown or other
  misc_feature (174)..(209): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacgttccatctacactactgagcgggctggcaaggcgcatagnnnnnnnnnnnnnnnnnnnnnnnnnnnnnnnnnnnn

SEQ ID NO: 200153 - DNA, 209 bp, Homo sapiens
  misc_feature: GYAE6OF01E6BRA.37.86.H09.1.454.CMB.1.raw
  modified_base (171)..(209): a, c, t, g, unknown or other
  misc_feature (171)..(209): n is a, c, g, or t
tcagtagtgtagatcacgaccggtgctcgatttagtgctatagacttgggtttgggggaagaggaagactgacggtccccaggagttcaggtgctgggcacagcggcctgggctgcctggtcaaggactacttccatctacactactgagcgggctggcaaggcgcatagnnnnnnnnnnnnnnnnnnnnnnnnnnnnnnnnnnnnnnn

SEQ ID NO: 200154 - DNA, 172 bp, Homo sapiens; identical to SEQ ID NO: 200143
  misc_feature: GYAE6OF01C98JK.37.86.H09.1.454.CMB.1.raw

SEQ ID NO: 200155 - DNA, 183 bp, Homo sapiens
  misc_feature: GYAE6OF01EI70Y.37.86.H09.1.454.CMB.1.raw
  modified_base (174)..(183): a, c, t, g, unknown or other
  misc_feature (174)..(183): n is a, c, g, or t
tcagtagtgtagatcacgaccggtgctcgatttagtgctatagacttgggtttagggggaagaggaagactgacggtcccccaggagttcaggtgctgggcacagcggccctgggctgcctggtcaaggactacttccatctacactactgagcgggctggcaaggcgcatagnnnnnnnnnn

SEQ ID NO: 200156 - DNA, 173 bp, Homo sapiens; identical to SEQ ID NO: 200127
  misc_feature: GYAE6OF01E2S0A.37.86.H09.1.454.CMB.1.raw
  modified_base (173)..(173): a, c, t, g, unknown or other
  misc_feature (173)..(173): n is a, c, g, or t

SEQ ID NO: 200157 - DNA, 173 bp, Homo sapiens; identical to SEQ ID NO: 200127
  misc_feature: GYAE6OF01DZFC5.37.86.H09.1.454.CMB.1.raw
  modified_base (173)..(173): a, c, t, g, unknown or other
  misc_feature (173)..(173): n is a, c, g, or t

SEQ ID NO: 200158 - DNA, 173 bp, Homo sapiens; identical to SEQ ID NO: 200127
  misc_feature: GYAE6OF01B91YJ.37.86.H09.1.454.CMB.1.raw
  modified_base (173)..(173): a, c, t, g, unknown or other
  misc_feature (173)..(173): n is a, c, g, or t

SEQ ID NO: 200159 - DNA, 196 bp, Homo sapiens
  misc_feature: GYAE6OF01ANR3F.37.86.H09.1.454.CMB.1.raw
  modified_base (174)..(196): a, c, t, g, unknown or other
  misc_feature (174)..(196): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacgttccatctacactactgagcgggctggcaaggcgcatagnnnnnnnnnnnnnnnnnnnnnnn

SEQ ID NO: 200160 - DNA, 255 bp, Homo sapiens; identical to SEQ ID NO: 200129
  misc_feature: GYAE6OF01DI2Y0.37.86.H09.1.454.CMB.1.raw
  modified_base (254)..(255): a, c, t, g, unknown or other
  misc_feature (254)..(255): n is a, c, g, or t

SEQ ID NO: 200161 - DNA, 204 bp, Homo sapiens
  misc_feature: GYAE6OF01ETBHX.37.86.H09.1.454.CMB.1.raw
  modified_base (177)..(204): a, c, t, g, unknown or other
  misc_feature (177)..(204): n is a, c, g, or t
tcagtagtgtagatcacgaccggtgctcgatttagtgctatagacttgggtttggggggaagaggaagactgacggtccccccaggagttcaggtgctgggccacagcggccctgggctgccctggtcaaggactacttccatctacactactgagcgggctggcaaggcgcatagnnnnnnnnnnnnnnnnnnnnnnnnnnnn

SEQ ID NO: 200162 - DNA, 173 bp, Homo sapiens; identical to SEQ ID NO: 200127
  misc_feature: GYAE6OF01ECQWQ.37.86.H09.1.454.CMB.1.raw
  modified_base (173)..(173): a, c, t, g, unknown or other
  misc_feature (173)..(173): n is a, c, g, or t

SEQ ID NO: 200163 - DNA, 176 bp, Homo sapiens
  misc_feature: GYAE6OF01ARIRG.37.86.H09.1.454.CMB.1.raw
  modified_base (173)..(176): a, c, t, g, unknown or other
  misc_feature (173)..(176): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnnnn

SEQ ID NO: 200164 - DNA, 173 bp, Homo sapiens; identical to SEQ ID NO: 200127
  misc_feature: GYAE6OF01CE6DR.37.86.H09.1.454.CMB.1.raw
  modified_base (173)..(173): a, c, t, g, unknown or other
  misc_feature (173)..(173): n is a, c, g, or t

SEQ ID NO: 200165 - DNA, 193 bp, Homo sapiens
  misc_feature: GYAE6OF01EIQRF.37.86.H09.1.454.CMB.1.raw
  modified_base (174)..(193): a, c, t, g, unknown or other
  misc_feature (174)..(193): n is a, c, g, or t
tcagtagtgtagatcacgaccggtgctcgatttagtgctatagacttgggtttgggggaagaggaagactgacggtcccccaggagttcaggtgctgggccacagcggccctgggctgcctggtcaaggactacttccatctacactactgagcgggctggcaaggcgcatagnnnnnnnnnnnnnnnnnnnn

SEQ ID NO: 200166 - DNA, 173 bp, Homo sapiens; identical to SEQ ID NO: 200127
  misc_feature: GYAE6OF01DDE8Q.37.86.H09.1.454.CMB.1.raw
  modified_base (173)..(173): a, c, t, g, unknown or other
  misc_feature (173)..(173): n is a, c, g, or t

SEQ ID NO: 200167 - DNA, 173 bp, Homo sapiens; identical to SEQ ID NO: 200127
  misc_feature: GYAE6OF01CIOFU.37.86.H09.1.454.CMB.1.raw
  modified_base (173)..(173): a, c, t, g, unknown or other
  misc_feature (173)..(173): n is a, c, g, or t

SEQ ID NO: 200168 - DNA, 244 bp, Homo sapiens
  misc_feature: GYAE6OF01C4IM3.37.86.H09.1.454.CMB.1.raw
  modified_base (158)..(158): a, c, t, g, unknown or other
  misc_feature (158)..(158): n is a, c, g, or t
  modified_base (181)..(244): a, c, t, g, unknown or other
  misc_feature (181)..(244): n is a, c, g, or t
tcagtagtgtagatcacgaccggtgctcgatttagtgctatagacttgggtttgggggggaagaggaagtactgtacggtcccccaggagttcaggttgctgggcacagcgggccctgggctgcctggtcaaggctacttccatctacactacgtgancggggctggcaaggcgcatagcnnnnnnnnnnnnnnnnnnnnnnnnnnnnnnnnnnnnnnnnnnnnnnnnnnnnnnnnnnnnnnnn

SEQ ID NO: 200169 - DNA, 173 bp, Homo sapiens; identical to SEQ ID NO: 200127
  misc_feature: GYAE6OF01BAWWN.37.86.H09.1.454.CMB.1.raw
  modified_base (173)..(173): a, c, t, g, unknown or other
  misc_feature (173)..(173): n is a, c, g, or t

SEQ ID NO: 200170 - DNA, 585 bp, Homo sapiens
  misc_feature: GYAE6OF01CY9YV.37.86.H09.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
  modified_base (326)..(326): a, c, t, g, unknown or other
  misc_feature (326)..(326): n is a, c, g, or t
  modified_base (341)..(341): a, c, t, g, unknown or other
  misc_feature (341)..(341): n is a, c, g, or t
  modified_base (374)..(374): a, c, t, g, unknown or other
  misc_feature (374)..(374): n is a, c, g, or t
  modified_base (407)..(407): a, c, t, g, unknown or other
  misc_feature (407)..(407): n is a, c, g, or t
tcagtagtgtagatcacgaccggtgctcgatttagtgctatagacttgggtttgggggaactgctcagttaggacccagacggaaccatggaagccccagcgcagcttctcttcctcctgctactctggctcccagataccactggagaaatagtgatgacgcagtctccagctaccctgtctgtgtctccgaggggaaanagcccaccctctcctgcagggccagtcagagtgttagcagcaacttgcctggtaccagcaagaaacctggccaggcctccgaggctcatcatctagtggtncatccacgacggccacgtggtacnccagtcctactttgngcaggtggtcgtggacagtagtcactccacacntcacgtcacgtccgtgacagttctaggtaagtnttttcgactttagtttattacgttacgtaacaacgtagtaactaagtcgtaacgtcggtcccttcgtaccgttacgtttcggggaaccggtaacggggaacctaaggggtggaacgtaacgtaacgaaaacgacgttcggtacggccgtacggaccctaactacttcgtcgtttcccg

SEQ ID NO: 200171 - DNA, 196 bp, Homo sapiens
  misc_feature: GYAE6OF01CG393.37.86.H09.1.454.CMB.1.raw
  modified_base (177)..(196): a, c, t, g, unknown or other
  misc_feature (177)..(196): n is a, c, g, or t
tcagtagtgtagatcacgaccggtgctcgatttagtgctatagacttggggtttgggggaagaggaagactgacggtcccccaggagttcaggtgctgggcacaggccggccctgggctgcctggtcaaggctacttccatcgtacactactgagcgggctgggcaaggcgcatagnnnnnnnnnnnnnnnnnnnn

SEQ ID NO: 200172 - DNA, 172 bp, Homo sapiens; identical to SEQ ID NO: 200143
  misc_feature: GYAE6OF01EJG18.37.86.H09.1.454.CMB.1.raw

SEQ ID NO: 200173 - DNA, 174 bp, Homo sapiens; identical to SEQ ID NO: 200128
  misc_feature: GYAE6OF01C83YG.37.86.H09.1.454.CMB.1.raw
  modified_base (173)..(174): a, c, t, g, unknown or other
  misc_feature (173)..(174): n is a, c, g, or t

SEQ ID NO: 200174 - DNA, 254 bp, Homo sapiens
  misc_feature: GYAE6OF01DC1M0.37.86.H09.1.454.CMB.1.raw
  modified_base (254)..(254): a, c, t, g, unknown or other
  misc_feature (254)..(254): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccatctacactactgagcgggctggcaaggcgcatagn

SEQ ID NO: 200175 - DNA, 184 bp, Homo sapiens
  misc_feature: GYAE6OF01D2NQW.37.86.H09.1.454.CMB.1.raw
  modified_base (173)..(184): a, c, t, g, unknown or other
  misc_feature (173)..(184): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnnnnnnnnnnnn

SEQ ID NO: 200176 - DNA, 173 bp, Homo sapiens
  misc_feature: GYAE6OF01CQP0J.37.86.H09.1.454.CMB.1.raw
tcagtagtgtagatcacgaccggtgctcgatttagtgctatagacttgggtttgggggaagaggaagactgacggtccccccaggagttcaggtgctgggcacagcggccctgggctgcctggtcaaggactacttccatctacactactgagcgggctggcaaggcgcatag

SEQ ID NO: 200177 - DNA, 534 bp, Homo sapiens
  misc_feature: GYAE6OF01DR43L.37.86.H09.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
  modified_base (351)..(351): a, c, t, g, unknown or other
  misc_feature (351)..(351): n is a, c, g, or t
tcagtagtgtagatcacgaccggtgctcgatttagtgctatagacttggggtttggggggaactgctcagttaggacccagacggaaccatggaagccccagcgcagcttctcttcctcctgctactctggctcccagataccactggagaaatagtgatgacgcagtctccagcccaccctgtctgtgtctccaggggaaanagccaccctctcctgcagggccagtcagagtgtagcagcaattgcctggtaccagcagaacctggccaggctcccagctcctcatctatggtncatccacgagggccactggactcccagccaggtcagtggcaggtggtctgggacngattcactctcacatcagcagtcctgcagttctagtaagtattttgctactttattactgtcagtactagtaataatacgtcgggtaccccgtacgtccggaccgaggaaccgaaggtacggaaattacgaaaacgtacgtaggtaggcgtacgcaacctacttactagttcttctagttccc

SEQ ID NO: 200178 - DNA, 255 bp, Homo sapiens; identical to SEQ ID NO: 200129
  misc_feature: GYAE6OF01CJ8NW.37.86.H09.1.454.CMB.1.raw
  modified_base (254)..(255): a, c, t, g, unknown or other
  misc_feature (254)..(255): n is a, c, g, or t

SEQ ID NO: 200179 - DNA, 173 bp, Homo sapiens; identical to SEQ ID NO: 200127
  misc_feature: GYAE6OF01EL1RA.37.86.H09.1.454.CMB.1.raw
  modified_base (173)..(173): a, c, t, g, unknown or other
  misc_feature (173)..(173): n is a, c, g, or t

SEQ ID NO: 200180 - DNA, 257 bp, Homo sapiens
  misc_feature: GYAE6OF01EROH4.37.86.H09.1.454.CMB.1.raw
  modified_base (254)..(257): a, c, t, g, unknown or other
  misc_feature (254)..(257): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccatctacactactgagcgggctggcaaggcgcatagnnnn

SEQ ID NO: 200181 - DNA, 258 bp, Homo sapiens
  misc_feature: GYAE6OF01CRWQH.37.86.H09.1.454.CMB.1.raw
  modified_base (254)..(258): a, c, t, g, unknown or other
  misc_feature (254)..(258): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 200182 - DNA, 176 bp, Homo sapiens
  misc_feature: GYAE6OF01E4Y6U.37.86.H09.1.454.CMB.1.raw
  modified_base (169)..(169): a, c, t, g, unknown or other
  misc_feature (169)..(169): n is a, c, g, or t
  modified_base (175)..(176): a, c, t, g, unknown or other
  misc_feature (175)..(176): n is a, c, g, or t
tcagtagtgtagatcacgaccggtgctcgatttagtgctatagacgttgggtttgggggaagaggaagactgaccggtcccccaggagttcaggtgctgggcacagcggccctgggctgcctggtcaaggactacttccatctacactactgagcgggctggcaaggcncatagnn

SEQ ID NO: 200183 - DNA, 180 bp, Homo sapiens
  misc_feature: GYAE6OF01CWJ94.37.86.H09.1.454.CMB.1.raw
  modified_base (173)..(180): a, c, t, g, unknown or other
  misc_feature (173)..(180): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnnnnnnnn

SEQ ID NO: 200184 - DNA, 187 bp, Homo sapiens
  misc_feature: GYAE6OF01CTKG9.37.86.H09.1.454.CMB.1.raw
  modified_base (175)..(187): a, c, t, g, unknown or other
  misc_feature (175)..(187): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcctatagnnnnnnnnnnnnn

SEQ ID NO: 200185 - DNA, 173 bp, Homo sapiens; identical to SEQ ID NO: 200127
  misc_feature: GYAE6OF01ADVB2.37.86.H09.1.454.CMB.1.raw
  modified_base (173)..(173): a, c, t, g, unknown or other
  misc_feature (173)..(173): n is a, c, g, or t

SEQ ID NO: 200186 - DNA, 185 bp, Homo sapiens; identical to SEQ ID NO: 200146
  misc_feature: GYAE6OF01BYENW.37.86.H09.1.454.CMB.1.raw
  modified_base (174)..(185): a, c, t, g, unknown or other
  misc_feature (174)..(185): n is a, c, g, or t

SEQ ID NO: 200187 - DNA, 672 bp, Homo sapiens
  misc_feature: GYAE6OF01DXURK.37.86.H09.1.454.CMB.1.raw
  modified_base (204)..(204): a, c, t, g, unknown or other
  misc_feature (204)..(204): n is a, c, g, or t
tcagtagtgtagatcacgaccggtgctcgatttagtgctatagacttgggtttgggggggaactgctcagttaggacccagacggaaccatggaagccccagcgcagcttctcttcctcctgctactctggctcccagataccactggagaaatagtgatgacgcagtctccagccaccctgtctgtgtctccgaaggggaaanagcccaccctctcctgcacggggccagtcagagtgttagcagcaacttagcctggtaaccagacaagaaacctggccaggcctcccgaggcctcctcattctagtggtcgcactcccaaccgacgggcctacgtcggtacctcccgacggtcctaggttcgaggtggcgagggttgggtctgggaacaggtagttcactctacaccatcgagcacgcctgctagtcgtaggtaatattttcgaccttaactttagttactgtacagtacgtaagttaactaacgtaaccggtcccggggtaccccggttaaggttacccgggaaccggtaaaccggggtaaccggtaaaaggggttaaacgggtaaaaccgtaaccggtaaaaccggtaaaccgttagggttaccgggactaccggaaccctaaccgtacgttaccgttacggttcctttaccgtacgtttacccccg

SEQ ID NO: 200188 - DNA, 177 bp, Homo sapiens
  misc_feature: GYAE6OF01DOXRY.37.86.H09.1.454.CMB.1.raw
  modified_base (177)..(177): a, c, t, g, unknown or other
  misc_feature (177)..(177): n is a, c, g, or t
tcagtagtgtagatcacgaccggtgctcgatttagtgctatagacttgggtttgggggaagaggaagactgaccggtccccccaggagttcaggtgctgggcacagccggccctgggctgcctggtcaaggactacttccaatctacactactgagcgggctggcaaggcgcatagn

SEQ ID NO: 200189 - DNA, 177 bp, Homo sapiens
  misc_feature: GYAE6OF01ASCUR.37.86.H09.1.454.CMB.1.raw
  modified_base (174)..(177): a, c, t, g, unknown or other
  misc_feature (174)..(177): n is a, c, g, or t
tcagtagtgtagatcacgaccggtgctcgatttagtgctatagacttgggtttgggggaagaggaagactgacggtccccccaggagttcaggtgctgggcacagcggccctgggctgcctggtcaaggactacttccatctacactactgagcgggctggcaaggcgcatagnnnn

SEQ ID NO: 200190 - DNA, 185 bp, Homo sapiens
  misc_feature: GYAE6OF01B06DG.37.86.H09.1.454.CMB.1.raw
  modified_base (174)..(185): a, c, t, g, unknown or other
  misc_feature (174)..(185): n is a, c, g, or t
tcagtagtgtagatcacgaccggtgctcgatttagtgctatagacttgggtttggggggaagaggaagactgacggtccccccaggagttcaggtgctgggcacagcgccctgggctgcctggtcaaggactacttccatctacactactgagcgggctggcaaggcgcatagnnnnnnnnnnnn

SEQ ID NO: 200191 - DNA, 173 bp, Homo sapiens
  misc_feature: GYAE6OF01B03Q5.37.86.H09.1.454.CMB.1.raw
tcagtagtgtagatcacgaccggtgctcgatttagtgctatagacttgggtttggggggaagaggaagactgacggtcccccaggagttcaggtgctgggcacagcggccctgggctgcctggtcaaggactacttccatctacactactgagcgggctggcaaggcgcatag

SEQ ID NO: 200192 - DNA, 255 bp, Homo sapiens; identical to SEQ ID NO: 200129
  misc_feature: GYAE6OF01BGAMU.37.86.H09.1.454.CMB.1.raw
  modified_base (254)..(255): a, c, t, g, unknown or other
  misc_feature (254)..(255): n is a, c, g, or t

SEQ ID NO: 200193 - DNA, 174 bp, Homo sapiens
  misc_feature: GYAE6OF01DVTSM.37.86.H09.1.454.CMB.1.raw
  modified_base (174)..(174): a, c, t, g, unknown or other
  misc_feature (174)..(174): n is a, c, g, or t
tcagtagtgtagatcacgaccggtgctcgatttagtgctatagacttgggtttgggggaagaggaagactgacggtccccctaggagttcaggtgctgggcacagcggccctgggctgcctggtcaaggactacttccatctacactactgagcgggctggcaaggcgcatagn

SEQ ID NO: 200194 - DNA, 310 bp, Homo sapiens
  misc_feature: GYAE6OF01BQ6VW.37.86.H09.1.454.CMB.1.raw
  modified_base (252)..(256): a, c, t, g, unknown or other
  misc_feature (252)..(256): n is a, c, g, or t
  modified_base (259)..(259): a, c, t, g, unknown or other
  misc_feature (259)..(259): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (269)..(310): a, c, t, g, unknown or other
  misc_feature (269)..(310): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggcaccctcctccaagagcacctctgggggcacagcggcctgggctgcctggtcaaggctacttccatctacactactgagcgggctggcaaggcgcatagnnnnnatnagntngctgnnnnnnnnnnnnnnnnnnnnnnnnnnnnnnnnnnnnnnnnnn

SEQ ID NO: 200195 - DNA, 179 bp, Homo sapiens
  misc_feature: GYAE6OF01DPHO6.37.86.H09.1.454.CMB.1.raw
  modified_base (175)..(179): a, c, t, g, unknown or other
  misc_feature (175)..(179): n is a, c, g, or t
tcagtagtgtagatcacgaccggtgctcgatttagtgctatagacttgggtttggggggaagaggaagactgaccggtcccccaggagttcaggtgctgggcacagcggccctgggctgcctggtcaaggactacttccatctacactactgagcgggctggcaaggcgcatagnnnnn

SEQ ID NO: 200196 - DNA, 209 bp, Homo sapiens
  misc_feature: GYAE6OF01CEG4X.37.86.H09.1.454.CMB.1.raw
  modified_base (178)..(209): a, c, t, g, unknown or other
  misc_feature (178)..(209): n is a, c, g, or t
tcagtagtgtagatcacgaccggtgctcgatttagtgctatagacttggggtttgggggaagaggaagactgacggtccccccaggagttcaggtgcgtgggcacaggccggccctgggctgcctggtcaaggctacttccatctacactacgtgagcgggctggcaaggcgcatagnnnnnnnnnnnnnnnnnnnnnnnnnnnnnnnn

SEQ ID NO: 200197 - DNA, 274 bp, Homo sapiens
  misc_feature: GYAE6OF01BFRHV.37.86.H09.1.454.CMB.1.raw
  modified_base (256)..(274): a, c, t, g, unknown or other
  misc_feature (256)..(274): n is a, c, g, or t
tcagtagtgtagatcacgaccggtgctcgatttagtgctatagacttggggtttggggggaattatcgttatggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccatctacactactgagcgggctggcaaggcgcatagnnnnnnnnnnnnnnnnnnn

SEQ ID NO: 200198 - DNA, 257 bp, Homo sapiens
  misc_feature: GYAE6OF01DN2FY.37.86.H09.1.454.CMB.1.raw
  modified_base (253)..(257): a, c, t, g, unknown or other
  misc_feature (253)..(257): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggccaccctcctccaagagcacctcgtgggggcacagcggccctgggctgcctggtcaaggactacttcatctacactactgagcggctggcaggcgcatagnnnnn

SEQ ID NO: 200199 - DNA, 208 bp, Homo sapiens
  misc_feature: GYAE6OF01EA68Q.37.86.H09.1.454.CMB.1.raw
  modified_base (178)..(208): a, c, t, g, unknown or other
  misc_feature (178)..(208): n is a, c, g, or t
tcagtagtgtagatcacgaccggtgctcgatttagtgctatagacttggggtttggggggaagaggaagactgacggtccccccaggagttcaggtgctgggcacgaggccggccctgggctgcctggtcaaggctacttccatctacactactgagcgggctggcaaggcgcatagnnnnnnnnnnnnnnnnnnnnnnnnnnnnnnn

SEQ ID NO: 200200 - DNA, 175 bp, Homo sapiens
  misc_feature: GYAE6OF01CL73Q.37.86.H09.1.454.CMB.1.raw
  modified_base (173)..(175): a, c, t, g, unknown or other
  misc_feature (173)..(175): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnnn

SEQ ID NO: 200201 - DNA, 174 bp, Homo sapiens
  misc_feature: GYAE6OF01ERB98.37.86.H09.1.454.CMB.1.raw
  modified_base (174)..(174): a, c, t, g, unknown or other
  misc_feature (174)..(174): n is a, c, g, or t
tcagtagtgtagatcacgaccggtgctcgatttagtgctatagacttgggtttgggggaagaggaagactgacggtccccccaggagttcaggtgctgggcacagcggccctgggctgcctggtcaaggactacttccatctacactactgagcgggctggcaaggcgcatagn

SEQ ID NO: 200202 - DNA, 189 bp, Homo sapiens
  misc_feature: GYAE6OF01BC3G1.37.86.H09.1.454.CMB.1.raw
  modified_base (174)..(189): a, c, t, g, unknown or other
  misc_feature (174)..(189): n is a, c, g, or t
tcagtagtgtagatcacgaccggtgctcgatttagtgctatagacgttgggtttggggggaagaggaagactgaccggtcccccaggagttcaggtgctgggcacagcggccctgggctgcctggtcaaggctactccatctacactactgagcgggctggcaaggcgcatagnnnnnnnnnnnnnnnn

SEQ ID NO: 200203 - DNA, 257 bp, Homo sapiens
  misc_feature: GYAE6OF01DAISQ.37.86.H09.1.454.CMB.1.raw
  modified_base (254)..(257): a, c, t, g, unknown or other
  misc_feature (254)..(257): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggcaccctcctccaagagcacctcgtgggggcacagcggcctgggctgcctggtcaaggctacttccatctacactactgaggcgggctggcaaggcgcatagnnnn

SEQ ID NO: 200204 - DNA, 614 bp, Homo sapiens
  misc_feature: GYAE6OF01ENT4C.37.86.H09.1.454.CMB.1.raw
  modified_base (201)..(201): a, c, t, g, unknown or other
  misc_feature (201)..(201): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtgcatccaccagggccacgtggtactcccagccaggtcagtggcaggtggtctgggacagagttcactctcaccatcagcacgcctgctagtactagtaagtattttgcttactttacttacttgtactacgtcgtaagttaacttaaagtaccgtaccggggtaccccggttaacggttcccgggaaccggtaacggggaacccgtaaagggttacgggtaaaacgtaaccgtaaaacgggtaaacgttagggttacggcggtacgtaccgtaacccgtacgttacgttaccgtttactttcgcctttacccccgg

SEQ ID NO: 200205 - DNA, 612 bp, Homo sapiens
  misc_feature: GYAE6OF01CQW6Q.37.86.H09.1.454.CMB.1.raw
tcagtagtgtagatcacgaccggtgctcgatttagtgctatagacttgggtttgggggggaagaggaagactgacggtccccccaggagttcaggtgctgggcacggtgggcatgtgtgagtttttgtcacaagatttgggctcaactctcctgtgcagcctctggattcacctttggcagctttgccatgagctgggtccgccaggctccgagggaggggctggaatgggtctcagccattagtagtagtggtggagcacgtactacgctgactccgtggaacgggccggttcgcccctctccgagacgaccaacctccaacaacaccgctcgtcctctcgactaaacttaacacgcctggaagacgaacgacggaccgacggtacgtaatattacgtgtcgacggaaagggagggtcaggcagtcgcctaggtacctcccactactatagtggacgtgcgggacaaaggactcgcggtccaccgtctcctacgactccctaccaccgaacggcccacggtcccgtcccgttccccgtcgacccctacccgtccctacccgaacgacgaccctaccgtccgggtacggggaccaccgcggcccggtcccgg

SEQ ID NO: 200206 - DNA, 674 bp, Homo sapiens
  misc_feature: GYAE6OF01CRG4A.37.86.H09.1.454.CMB.1.raw
  modified_base (444)..(444): a, c, t, g, unknown or other
  misc_feature (444)..(444): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggaggaatagtgatgacgcagtcgccagccaccctgtctgtgtctccgaggggaaagacgccaccctctcctgcagggcctctcagagtgtagcggccacttagcctggtaccagcaacgaaaccgtggaccacggcctcccgaggcctccgtcatctatgagcactcccgaccgacgggccacgtgtactcccgagccgaggttacaggtggacgtagggtggtctaggaagacaagtactcactctacaccgtagtccggactacgccctgtaccgaggttcctaggtaaacgtttntttttacggaccgtttaaggtttttactttcgtagttacctacggtaccgttaacggttacgtacgttttaacggtttcccggaccccttaccgtaccttacccgttacccgttccgggaaacccgttaaacggggacctaaaccgggtacgtaagggtacgtaaacgttaaccggacgttaacggttcggtacgtaccgttacgaaccctaccggtgttccctttacgg

SEQ ID NO: 200207 - DNA, 735 bp, Homo sapiens
  misc_feature: GYAE6OF01EKWDS.37.86.H09.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (392)..(392): a, c, t, g, unknown or other
  misc_feature (392)..(392): n is a, c, g, or t
tcagtagtgtagatcacgaccggtgctcgatttagtgctatagacttggggtttggggggaagaggaagactgacggtcccccaggagttcaggtgctgggcacgggtgggcatgtgtgagttttgtcacaagatttgggctcaactctcctgtgcagcctctggattcacctttggcagtctttgccatgagctgggtccncaggctcgaggggaggctggatggtctnagcattagngtagtggagagctagtactacgctgacgttccggtggaacgggtccgttcgccctctccagacactaactacaaccacacgctagtctctagactaacttaacgcgtcctggaagacgacggaacggaccaaggtaccgtattaacgttacgnggttacggacggtaaacgggaacgttctaacggcgtaggttcgtaccgtaccgttaccgtacccttaacgaacgttttttacgacggtaccgggtacgttacggtacggggaacgtaaagggtaaccggttaccggtaccgggttacccttacccggtacttacccgtaccgaccgttacccgtacccggaacccggtaaccggtaccccgtacgttccccgggttacccctttcccccggtaccggtaccccgtaccccgttacccgtaacccgtaccggaaccgtccccggaacccgttccggtacgggggaccctacgggcccggtacccgggtcccggg

SEQ ID NO: 200208 - DNA, 270 bp, Homo sapiens
  misc_feature: GYAE6OF01D0ZWU.37.86.H09.1.454.CMB.1.raw
  modified_base (256)..(270): a, c, t, g, unknown or other
  misc_feature (256)..(270): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggccaccctcctccaagagcacctctgggggcacagcggccctgggctgcctggtcaaggactacttccatctacactactgagcgggctggacaaggcgcatagnnnnnnnnnnnnnnn

SEQ ID NO: 200209 - DNA, 175 bp, Homo sapiens; identical to SEQ ID NO: 200200
  misc_feature: GYAE6OF01CSA0P.37.86.H09.1.454.CMB.1.raw
  modified_base (173)..(175): a, c, t, g, unknown or other
  misc_feature (173)..(175): n is a, c, g, or t

SEQ ID NO: 200210 - DNA, 657 bp, Homo sapiens
  misc_feature: GYAE6OF01C156J.37.86.H09.1.454.CMB.1.raw
  modified_base (207)..(207): a, c, t, g, unknown or other
  misc_feature (207)..(207): n is a, c, g, or t
  modified_base (324)..(324): a, c, t, g, unknown or other
  misc_feature (324)..(324): n is a, c, g, or t
  modified_base (438)..(438): a, c, t, g, unknown or other
  misc_feature (438)..(438): n is a, c, g, or t
tcagtagtgtagatcacgaccggtgctcgatttagtgctatagacttggggtttgggggggaactgctcagttaggacccagacggaaccatggaagccccagcgcagcttctcttcctcctgctactctggcctccagataccactggaagaaatagtgatgacgcagtctccagccaccctgtctgtgtcctccgaaggggaaanacgcccaccctctcctgcgagggccagtcagagttgtagcagctaactgcctaggtaccagacaacgaaacctggccaaggcctacccgaggcctacctcaactcgttaatcgggtnaccacgtacccaaccgacggggcccaacgtcggtaactccccaaggtcccgagggtttcaggtcggacgtaggtcgggtcgtagggacagtacgttccactctacacatcagcncgacctgaccagttacgtagtaaagttcttttgaccttaacttttatacgttgtactagactaacgtaaataacgttaaccgtccgggtaccccgggtacggttaccggaacccggacgggtaaccgtaaacgggtaacgtaaacgtaacgtaaacggaaccgttggacggtacgcgacccaaccgttacgtaccgttgtacccttcctacgttccccg

SEQ ID NO: 200211 - DNA, 814 bp, Homo sapiens
  misc_feature: GYAE6OF01BVQUG.37.86.H09.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagtagtgtagatcacgaccggtgctcgatttagtgctatagacttgggtttggggggaactgctcagttaggacccagacggaaccatggaagcccccagcgcagcttctcttcctcctgctactctggctcccagataccactggagaaatagtgatgacgcagtctccagccaccctgtctgtcgtctccgaggggaaancgccaccctctcctgcagggccagtcagngtgtagcagctaacgttcgcctggtacagccaacggaaacctcggaccgacggcctacccgacgggtcctcccgtacctattccgtagtacgggtcgacctaccgtccctaaccggagggcccctagtacgggttactaccccacgtccgtaggttccgaggtcggacgtacggggtcggggttccgtaggggaacctaagggtacgtttaccgaaccgtttcccgtacccgtaaccgtaacgtacgaacgggtccctaaccgggtcccggttacggacccgggtaacggggttaccgtaggggaacgggtacgttacgggggttaccggggttaacgtttaagtttttaacgtttaaccggttcggttaaccgtaacgttaaccgtaagttttaaactttaaacgtttaaaccctttacccgtttaccccgggttaacccgtaaccggggtttacccgggaaacccggttaaacggggtaaaccgtaaacgggtaacggtaaaacgttaccggtaaaaccggtacgttcgggacggtacgtaccgtacccgaaccttacgttcttaaccgttccttaccg

SEQ ID NO: 200212 - DNA, 785 bp, Homo sapiens
  misc_feature: GYAE6OF01BS1PS.37.86.H09.1.454.CMB.1.raw
  modified_base (203)..(203): a, c, t, g, unknown or other
  misc_feature (203)..(203): n is a, c, g, or t
  modified_base (339)..(339): a, c, t, g, unknown or other
  misc_feature (339)..(339): n is a, c, g, or t
  modified_base (755)..(755): a, c, t, g, unknown or other
  misc_feature (755)..(755): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagccaccctgtctgtgtctccgaagggggaancgccaccctctcctgcgagggccagtcagtagtgttagcagactaacttacgcctagggtaccagtacaaccggtaaacccgtcggacccacggccctacccgaggtccctccctactattccgtagtcgggttcnccgtaacctcccgaaccggtcgggaccctacgttcggtacctccccgacggtacccgtaggttccgaaggtcggccggtaggggttcgggtacgtaggggaacctaggttacgtttacccgaaccgttccttaacccaacccgtagttaccgaacgtaccgtaccggtccgtacgtacgttacggttacgttaacggaacgtttttacgtttcgggttaaccttttacgttttaaacgttccggtttacgtaccgtaacgttacgtaaacgtttaagttaaaccgttacccgggtccccggggtaaccccggttaccgggttaccgggaacccggtaaacggggtaaccgtaaaggggttaaccgtaaacgtaaccggtaaacggtacctagggtacggtcgtacgacctaccgtnttaccgtacgttcctattccggttaccccg

SEQ ID NO: 200213 - DNA, 179 bp, Homo sapiens
  misc_feature: GYAE6OF01A0ZTC.37.86.H09.1.454.CMB.1.raw
  modified_base (173)..(179): a, c, t, g, unknown or other
  misc_feature (173)..(179): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnnnnnnn

SEQ ID NO: 200214 - DNA, 757 bp, Homo sapiens
  misc_feature: GYAE6OF01EVM1Q.37.86.H09.1.454.CMB.1.raw
  modified_base (205)..(205): a, c, t, g, unknown or other
  misc_feature (205)..(205): n is a, c, g, or t
tcagtagtgtagatcacgaccggtgctcgatttagtgctatagacttggggtttgggggggaactgctcagttaggacccagacggaaccatggaagccccagcgcagcttctcttcctcctgctactctggctcccagataccactggagaaatagtgatgacgcagtctccagccaccctgtctgtgtctaccgaggggaaanagcccaccctctcctgcagggccagtcagagtgtacgcagcaacgttacgccgtggtaaccagacaacgtaaaccgtggccgaacggcctacccgacggcctcctcgatacgtagtcggttcgccaactcccaaccggtacgggccctaacggttggtaacctccccgaacgcccgtaaggtttccaggtcgggactagggtcgggtcgtagggacgtagtgttaccacgttctaccaccgatcagcctacgccgtacgtactagtacgttacggtaagttacgttttacggtaacgttttaagtttaacgttttaacgttaccgtttaaacctaaaccggttaacctaacggtaacttacgggtaaaccgttccgggttacccctttaaccttcccggtttaaccggttttaccggggaccggggtaaacggggttaacccggtaaaggggttaccggtaaaggtaaacccgtaaacgtaaaaaccggtaaccggttagggtaccggaaaccggttacgaaccctaacccgttattccggtttcgtaaccg

SEQ ID NO: 200215 - DNA, 189 bp, Homo sapiens
  misc_feature: GYAE6OF01B509N.37.86.H09.1.454.CMB.1.raw
  modified_base (174)..(189): a, c, t, g, unknown or other
  misc_feature (174)..(189): n is a, c, g, or t
tcagtagtgtagatcacgaccggtgctcgatttagtgctatagacttgggtttggggggaagaggaagactgacggtccccccaggagttcaggtgctgggcacagcggccctgggctgcctggtcaaggactacttccatctacactactgagcggctggcaaggcacatagnnnnnnnnnnnnnnnn

SEQ ID NO: 200216 - DNA, 989 bp, Homo sapiens
  misc_feature: GYAE6OF01EEPN8.37.86.H09.1.454.CMB.1.raw
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgcagggccagtcagagtgttacgcagactaacgttacgccgtagggtaacccaagaccgtaacggaaaacccgtcgggacccaacggggcccttaccccgaagggtcccttacccctacgtaactttaccgtaacgttcgggttacggacctacgttacccccgaaccggtaacggggaccccttaaccggttacggggtaaccttacccccggaacggtacccgttaacgggtttaccgtaacgggttcgggaccggtaggggttacggggttaccggtaaggggaacctagggtaacgttccaaccgttccctaaccaacccgtaacgttaccgaacggtccgtaaacccggtcccttaggaccgtaacggtttaccgaaagggttaaacgtttacgtttttaaccgggactttttaaacccgtttttagtttaaccggttggttaaccgtaacggttaaccgttaaagtttaaccgttaaaaccgtttaaccggggtacccccggggttaaccccggggttaccggtttaaccccggggaacccgggtaaaccgggggttaaaccccggtaaaacggggtttaaacggggaaaaaacccgtttaaacccgggaaaaaacccgggtttaaaccgggttaaggggttacccccggggttaaaccgtttacccggaaccccgtttaaacccccccggttagtttaccccccggtttaccgggtttttaaccccttttaaaccgtttacccccggttttaaaccccccccggg

SEQ ID NO: 200217 - DNA, 187 bp, Homo sapiens
  misc_feature: GYAE6OF02IF2HN.37.86.H09.1.454.CMB.1.raw
  modified_base (171)..(187): a, c, t, g, unknown or other
  misc_feature (171)..(187): n is a, c, g, or t
tcagtagtgtagatcacgaccggtgctcgatttagtgctatagacttgggttggggaagaggaagactgacggtcccccaggagttcaggtgctgggcacagcggccctggactgcctggtcaaggactacttccatctacactactgagcgggctggcaaggcgcatagnnnnnnnnnnnnnnnnn

SEQ ID NO: 200218 - DNA, 173 bp, Homo sapiens; identical to SEQ ID NO: 200127
  misc_feature: GYAE6OF02G648L.37.86.H09.1.454.CMB.1.raw
  modified_base (173)..(173): a, c, t, g, unknown or other
  misc_feature (173)..(173): n is a, c, g, or t

SEQ ID NO: 200219 - DNA, 171 bp, Homo sapiens; identical to SEQ ID NO: 200121
  misc_feature: GYAE6OF02GNT5D.37.86.H09.1.454.CMB.1.raw
  modified_base (171)..(171): a, c, t, g, unknown or other
  misc_feature (171)..(171): n is a, c, g, or t

SEQ ID NO: 200220 - DNA, 173 bp, Homo sapiens
  misc_feature: GYAE6OF02HG60R.37.86.H09.1.454.CMB.1.raw
  modified_base (172)..(173): a, c, t, g, unknown or other
  misc_feature (172)..(173): n is a, c, g, or t
tcagtagtgtagatcacgaccggtgctcgatttagtgctatagacttgggtttggggaagaggaagactgacggtcccccaggagttcaggtgctgggcacagcggccctgggctgcctggtcaaggactacttccatctacactactgagcgggctggcaaggcgcatagnn

SEQ ID NO: 200221 - DNA, 183 bp, Homo sapiens
  misc_feature: GYAE6OF02I8BZI.37.86.H09.1.454.CMB.1.raw
  modified_base (172)..(183): a, c, t, g, unknown or other
  misc_feature (172)..(183): n is a, c, g, or t
tcagtagtgtagatcacgaccggtgctcgatttagtgctatagacttgggtttggggaagaggaagactgacggtccccaggagttcaggtgctgggcacagcggccctgggctgcctggtcaaggactacttccatctacactactgagcgggctgggcaaggcgcatagnnnnnnnnnnnn

SEQ ID NO: 200222 - DNA, 171 bp, Homo sapiens; identical to SEQ ID NO: 200121
  misc_feature: GYAE6OF02IIYI0.37.86.H09.1.454.CMB.1.raw
  modified_base (171)..(171): a, c, t, g, unknown or other
  misc_feature (171)..(171): n is a, c, g, or t

SEQ ID NO: 200223 - DNA, 175 bp, Homo sapiens; identical to SEQ ID NO: 200200
  misc_feature: GYAE6OF02GN0D6.37.86.H09.1.454.CMB.1.raw
  modified_base (173)..(175): a, c, t, g, unknown or other
  misc_feature (173)..(175): n is a, c, g, or t

SEQ ID NO: 200224 - DNA, 171 bp, Homo sapiens
  misc_feature: GYAE6OF02GW0MC.37.86.H09.1.454.CMB.1.raw
  modified_base (170)..(171): a, c, t, g, unknown or other
  misc_feature (170)..(171): n is a, c, g, or t
tcagtagtgtagatcacgaccggtgctcgatttagtgctatagacttgggtttggggaagaggaagactgacggtccccaggagttcaggtgctgggcacagcggccctggctgcctggtcaaggactacttccatctacactactgagcgggctggcaaggcgcatagnn

SEQ ID NO: 200225 - DNA, 168 bp, Homo sapiens
  misc_feature: GYAE6OF02I31D0.37.86.H09.1.454.CMB.1.raw
  modified_base (167)..(168): a, c, t, g, unknown or other
  misc_feature (167)..(168): n is a, c, g, or t
tcagtagtgtagatcacgaccggtgctcgatttagtgctatagacttggttgggaagaggaagactgacggtcccaggagttcaggtgctgggcacagcggccctgggctgcctggtcaaggactacttccatctacactactgagcgggctggcaaggcgcatagnn

SEQ ID NO: 200226 - DNA, 173 bp, Homo sapiens; identical to SEQ ID NO: 200127
  misc_feature: GYAE6OF02HASJ5.37.86.H09.1.454.CMB.1.raw
  modified_base (173)..(173): a, c, t, g, unknown or other
  misc_feature (173)..(173): n is a, c, g, or t

SEQ ID NO: 200227 - DNA, 171 bp, Homo sapiens; identical to SEQ ID NO: 200121
  misc_feature: GYAE6OF02GL6HP.37.86.H09.1.454.CMB.1.raw
  modified_base (171)..(171): a, c, t, g, unknown or other
  misc_feature (171)..(171): n is a, c, g, or t

SEQ ID NO: 200228 - DNA, 190 bp, Homo sapiens
  misc_feature: GYAE6OF02GUR6E.37.86.H09.1.454.CMB.1.raw
  modified_base (170)..(190): a, c, t, g, unknown or other
  misc_feature (170)..(190): n is a, c, g, or t
tcagtagtgtagatcacgaccggtgctcgatttagtgctatagacttgggttgggggaagaggaagactgacggtccccaggagttcaggtgctgggcacagcggccctggctgcctggtcaaggactaccttccatctacactactgagcggctggcaaggcgcatagnnnnnnnnnnnnnnnnnnnnn

SEQ ID NO: 200229 - DNA, 274 bp, Homo sapiens
  misc_feature: GYAE6OF02IP667.37.86.H09.1.454.CMB.1.raw
  modified_base (258)..(274): a, c, t, g, unknown or other
  misc_feature (258)..(274): n is a, c, g, or t
tcagtagtgtagatcacgaccggtgctcgatttagtgctatagacttggggtttggggaattatcgttatggtgcttttgatatctggggccaagggacaatggtcaccgtctcttcagcctccaccaagggcccatcggtcttccccctggcaccctcctccaagagcacctctgggggtacacagcggccctgggctgcctggtcaaggactacttccgatctacactacgtgagcgggctggcaaggcgcatagnnnnnnnnnnnnnnnnn

SEQ ID NO: 200230 - DNA, 626 bp, Homo sapiens
  misc_feature: GYAE6OF02IWCXH.37.86.H09.1.454.CMB.1.raw
  modified_base (318)..(318): a, c, t, g, unknown or other
  misc_feature (318)..(318): n is a, c, g, or t
tcagtagtgtagatcacgaccggtgctcgatttagtgctatagacttgggtttgggggaactgcctcagttaggacccagacggaaccattggaagccccagctcagcttctcttcctcctgctactctggctcccagtataccaccgcaggtaaattgtgttgactacagtctccagccaccctgtctttgtctccgaggggagagaggccaccctctcctgccaggggccagtcagaatgttagcagtcacttagcctggtaccaacagagacctggccaggcccccaggctcctcagtcatagctgcttaccgtnagggccacgtggcatccctagcctaggttcaggtcggctaggttgggtcttggagacagtacttcaccttcgtacgaccatcagcagtctaagagaccctagaacgtagttttacgactaacttttatatttcgtagttacaaacagtccgtactacctaaccgtgggttacggtaaccgtttccggaccgtaaacgggtacctaaagggttacggtagtttacccggtaacgaaacggttcggttacgggtaccttaggtaccgtacctacgttaccgttcggtaccgtttaccgaacgtttccccg

SEQ ID NO: 200231 - DNA, 256 bp, Homo sapiens
  misc_feature: GYAE6OF02I61TP.37.86.H09.1.454.CMB.1.raw
  modified_base (182)..(182): a, c, t, g, unknown or other
  misc_feature (182)..(182): n is a, c, g, or t
  modified_base (184)..(185): a, c, t, g, unknown or other
  misc_feature (184)..(185): n is a, c, g, or t
  modified_base (187)..(256): a, c, t, g, unknown or other
  misc_feature (187)..(256): n is a, c, g, or t
tcagtagtgtagatcacgaccggtgctcgatttagtgctatagacttgggttgggggaagaggaagtactgtacggtcccccaggagttcaggttgctgggcacagcgggccctgggctgacctggtccaaggacgtacttccagtctacactacgtgagtcgggctggcaaggcgcatagncnncnnnnnnnnnnnnnnnnnnnnnnnnnnnnnnnnnnnnnnnnnnnnnnnnnnnnnnnnnnnnnnnnnnnnnn

SEQ ID NO: 200232 - DNA, 254 bp, Homo sapiens
  misc_feature: GYAE6OF02I0KAM.37.86.H09.1.454.CMB.1.raw
  modified_base (253)..(254): a, c, t, g, unknown or other
  misc_feature (253)..(254): n is a, c, g, or t
tcagtagtgtagatcacgaccggtgctcgatttagtgctatagacttgggtttggggaattatcgttatggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccatctacactactgagcgggctggcaaggcgcatagnn

SEQ ID NO: 200233 - DNA, 172 bp, Homo sapiens; identical to SEQ ID NO: 200125
  misc_feature: GYAE6OF02HNSHZ.37.86.H09.1.454.CMB.1.raw
  modified_base (171)..(172): a, c, t, g, unknown or other
  misc_feature (171)..(172): n is a, c, g, or t

SEQ ID NO: 200234 - DNA, 188 bp, Homo sapiens; identical to SEQ ID NO: 200138
  misc_feature: GYAE6OF02GMVE9.37.86.H09.1.454.CMB.1.raw
  modified_base (173)..(188): a, c, t, g, unknown or other
  misc_feature (173)..(188): n is a, c, g, or t

SEQ ID NO: 200235 - DNA, 172 bp, Homo sapiens; identical to SEQ ID NO: 200125
  misc_feature: GYAE6OF02FHW0R.37.86.H09.1.454.CMB.1.raw
  modified_base (171)..(172): a, c, t, g, unknown or other
  misc_feature (171)..(172): n is a, c, g, or t

SEQ ID NO: 200236 - DNA, 173 bp, Homo sapiens; identical to SEQ ID NO: 200127
  misc_feature: GYAE6OF02HCQ1P.37.86.H09.1.454.CMB.1.raw
  modified_base (173)..(173): a, c, t, g, unknown or other
  misc_feature (173)..(173): n is a, c, g, or t

SEQ ID NO: 200237 - DNA, 174 bp, Homo sapiens; identical to SEQ ID NO: 200128
  misc_feature: GYAE6OF02INIUU.37.86.H09.1.454.CMB.1.raw
  modified_base (173)..(174): a, c, t, g, unknown or other
  misc_feature (173)..(174): n is a, c, g, or t

SEQ ID NO: 200238 - DNA, 128 bp, Homo sapiens
  misc_feature: GYAE6OF02IUBM0.37.86.H09.1.454.CMB.1.raw
tcagtagtgtagatcacgaccggtgctcgatttagtgctatagacttgggtttgtgcacagcggccctgggctgcctggtcaaggatacttccatctacactactgagcgggctggcaaggcgcatag

SEQ ID NO: 200239 - DNA, 172 bp, Homo sapiens
  misc_feature: GYAE6OF02GH0IK.37.86.H09.1.454.CMB.1.raw
  modified_base (172)..(172): a, c, t, g, unknown or other
  misc_feature (172)..(172): n is a, c, g, or t
tcagtagtgtagatcacgaccggtgctcgatttagtgctatagacttgggtttggggaagaggaagactgacggtcccccaggagttcaggtgctgggcacagcggccctgggctgcctggtcaaggactacttccatctacactactgagcgggctggcaaggcgcatagn

SEQ ID NO: 200240 - DNA, 212 bp, Homo sapiens
  misc_feature: GYAE6OF02HSSY9.37.86.H09.1.454.CMB.1.raw
  modified_base (176)..(212): a, c, t, g, unknown or other
  misc_feature (176)..(212): n is a, c, g, or t
tcagtagtgtagatcacgaccggtgctcgatttagtgctatagacttgggtttgggggaagaggaagactgacggtcccccaggagttcaggtgcctgggcacgacgcggccctgggctgcctggtcaaggactacttccatctacactactgagcgggctggcaaggcgcatagnnnnnnnnnnnnnnnnnnnnnnnnnnnnnnnnnnnnn

SEQ ID NO: 200241 - DNA, 173 bp, Homo sapiens; identical to SEQ ID NO: 200127
  misc_feature: GYAE6OF02F3T8A.37.86.H09.1.454.CMB.1.raw
  modified_base (173)..(173): a, c, t, g, unknown or other
  misc_feature (173)..(173): n is a, c, g, or t

SEQ ID NO: 200242 - DNA, 191 bp, Homo sapiens
  misc_feature: GYAE6OF02JAY9B.37.86.H09.1.454.CMB.1.raw
  modified_base (175)..(191): a, c, t, g, unknown or other
  misc_feature (175)..(191): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacgttccatctacactactggagcgggctggcaaggcgcatagnnnnnnnnnnnnnnnnn

SEQ ID NO: 200243 - DNA, 183 bp, Homo sapiens
  misc_feature: GYAE6OF02IHZ0Z.37.86.H09.1.454.CMB.1.raw
  modified_base (173)..(183): a, c, t, g, unknown or other
  misc_feature (173)..(183): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnnnnnnnnnnn

SEQ ID NO: 200244 - DNA, 173 bp, Homo sapiens; identical to SEQ ID NO: 200127
  misc_feature: GYAE6OF02HUOIK.37.86.H09.1.454.CMB.1.raw
  modified_base (173)..(173): a, c, t, g, unknown or other
  misc_feature (173)..(173): n is a, c, g, or t

SEQ ID NO: 200245 - DNA, 174 bp, Homo sapiens; identical to SEQ ID NO: 200128
  misc_feature: GYAE6OF02JCEVR.37.86.H09.1.454.CMB.1.raw
  modified_base (173)..(174): a, c, t, g, unknown or other
  misc_feature (173)..(174): n is a, c, g, or t

SEQ ID NO: 200246 - DNA, 174 bp, Homo sapiens; identical to SEQ ID NO: 200128
  misc_feature: GYAE6OF02HKZCF.37.86.H09.1.454.CMB.1.raw
  modified_base (173)..(174): a, c, t, g, unknown or other
  misc_feature (173)..(174): n is a, c, g, or t

SEQ ID NO: 200247 - DNA, 186 bp, Homo sapiens
  misc_feature: GYAE6OF02HOLVU.37.86.H09.1.454.CMB.1.raw
  modified_base (174)..(186): a, c, t, g, unknown or other
  misc_feature (174)..(186): n is a, c, g, or t
tcagtagtgtagatcacgaccggtgctcgatttagtgctatagacgttgggtttgggggaagaggaagactgacggtcccccaggagttcaggtgctgggcacagcggccctgggctgcctggtcaaggactacttccatctacactactgagcgggctggcaaggcgcatagnnnnnnnnnnnnn

SEQ ID NO: 200248 - DNA, 173 bp, Homo sapiens; identical to SEQ ID NO: 200127
  misc_feature: GYAE6OF02G58YJ.37.86.H09.1.454.CMB.1.raw
  modified_base (173)..(173): a, c, t, g, unknown or other
  misc_feature (173)..(173): n is a, c, g, or t

SEQ ID NO: 200249 - DNA, 173 bp, Homo sapiens; identical to SEQ ID NO: 200127
  misc_feature: GYAE6OF02H3OXY.37.86.H09.1.454.CMB.1.raw
  modified_base (173)..(173): a, c, t, g, unknown or other
  misc_feature (173)..(173): n is a, c, g, or t

SEQ ID NO: 200250 - DNA, 178 bp, Homo sapiens
  misc_feature: GYAE6OF02FSW6J.37.86.H09.1.454.CMB.1.raw
  modified_base (173)..(178): a, c, t, g, unknown or other
  misc_feature (173)..(178): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactactgagcgggctggcaaggcgcatagnnnnnn

SEQ ID NO: 200251 - DNA, 173 bp, Homo sapiens; identical to SEQ ID NO: 200127
  misc_feature: GYAE6OF02G2TP4.37.86.H09.1.454.CMB.1.raw
  modified_base (173)..(173): a, c, t, g, unknown or other
  misc_feature (173)..(173): n is a, c, g, or t

SEQ ID NO: 200252 - DNA, 173 bp, Homo sapiens; identical to SEQ ID NO: 200127
  misc_feature: GYAE6OF02I39AZ.37.86.H09.1.454.CMB.1.raw
  modified_base (173)..(173): a, c, t, g, unknown or other
  misc_feature (173)..(173): n is a, c, g, or t

SEQ ID NO: 200253 - DNA, 174 bp, Homo sapiens; identical to SEQ ID NO: 200128
  misc_feature: GYAE6OF02GWLNT.37.86.H09.1.454.CMB.1.raw
  modified_base (173)..(174): a, c, t, g, unknown or other
  misc_feature (173)..(174): n is a, c, g, or t

SEQ ID NO: 200254 - DNA, 255 bp, Homo sapiens; identical to SEQ ID NO: 200129
  misc_feature: GYAE6OF02IXF3Q.37.86.H09.1.454.CMB.1.raw
  modified_base (254)..(255): a, c, t, g, unknown or other
  misc_feature (254)..(255): n is a, c, g, or t

SEQ ID NO: 200255 - DNA, 190 bp, Homo sapiens
  misc_feature: GYAE6OF02HBHZS.37.86.H09.1.454.CMB.1.raw
  modified_base (175)..(190): a, c, t, g, unknown or other
  misc_feature (175)..(190): n is a, c, g, or t
tcagtagtgtagatcacgaccggtgctcgatttagtgctatagacttgggtttgggggaagaggaagactgacggtcccccaggagttcaggtgctgggccacagcggccctgggctgcctggtcaaggactacttccatctacactactgagcgggactggcaaggcgcatagnnnnnnnnnnnnnnnn

SEQ ID NO: 200256 - DNA, 274 bp, Homo sapiens
  misc_feature: GYAE6OF02IFPP2.37.86.H09.1.454.CMB.1.raw
  modified_base (201)..(202): a, c, t, g, unknown or other
  misc_feature (201)..(202): n is a, c, g, or t
  modified_base (204)..(205): a, c, t, g, unknown or other
  misc_feature (204)..(205): n is a, c, g, or t
  modified_base (207)..(207): a, c, t, g, unknown or other
  misc_feature (207)..(207): n is a, c, g, or t
  modified_base (209)..(211): a, c, t, g, unknown or other
  misc_feature (209)..(211): n is a, c, g, or t
  modified_base (215)..(274): a, c, t, g, unknown or other
  misc_feature (215)..(274): n is a, c, g, or t
tcagtagtgtagatcacgaccggtgctcgatttagtgctatagacttgggggtttggggggaagaggaagactgtacgggtcccccccaggaggttaccaggtggactccgggcacagcggcccttgggcttgcccttggtcaaggactacgttccactctacacctaccgtgaagtcgggctggcaaggcgtcatacgcnntnncngnnngccnnnnnnnnnnnnnnnnnnnnnnnnnnnnnnnnnnnnnnnnnnnnnnnnnnnnnnnnnnnn

SEQ ID NO: 200257 - DNA, 173 bp, Homo sapiens; identical to SEQ ID NO: 200127
  misc_feature: GYAE6OF02JH9RK.37.86.H09.1.454.CMB.1.raw
  modified_base (173)..(173): a, c, t, g, unknown or other
  misc_feature (173)..(173): n is a, c, g, or t

SEQ ID NO: 200258 - DNA, 183 bp, Homo sapiens
  misc_feature: GYAE6OF02FPOD6.37.86.H09.1.454.CMB.1.raw
  modified_base (175)..(183): a, c, t, g, unknown or other
  misc_feature (175)..(183): n is a, c, g, or t
tcagtagtgtagatcacgaccggtgctcgatttagtgctatagacttgggtttggggggaagaggaagactgacggtccccccaggagttcaggtgctgggcacagcggccctgggctgcctggtcaaggactacttccatctacactactgagcgggctggcaaggcgcatagnnnnnnnnn

SEQ ID NO: 200259 - DNA, 173 bp, Homo sapiens
  misc_feature: GYAE6OF02HUA09.37.86.H09.1.454.CMB.1.raw
tcagtagtgtagatcacgaccggtgctcgatttagtgctatagacttgggtttgggggaagaggaagactgacggtcccccaggagttcaggtgctgggcacagcggccctgggctgcctggtcaaggactacttccattctacactactgagcgggctggcaaggcgcatag

SEQ ID NO: 200260 - DNA, 174 bp, Homo sapiens
  misc_feature: GYAE6OF02FN4EO.37.86.H09.1.454.CMB.1.raw
  modified_base (174)..(174): a, c, t, g, unknown or other
  misc_feature (174)..(174): n is a, c, g, or t
tcagtagtgtagatcacgaccggtgctcgatttagtgctatagacttgggtttgggggaagaggaagactgacggtccccccaggagttcaggtgctgtgcacagcggccctgggctgcctggtcaaggactacttccatctacactactgagcgggctggcaaggcgcatagn

SEQ ID NO: 200261 - DNA, 175 bp, Homo sapiens
  misc_feature: GYAE6OF02HG79N.37.86.H09.1.454.CMB.1.raw
  modified_base (174)..(175): a, c, t, g, unknown or other
  misc_feature (174)..(175): n is a, c, g, or t
tcagtagtgtagatcacgaccggtgctcgatttagtgctatagacttgggtttgggggaagaggaagactgacggtccccccaggagttcaggtgctgggcacagcggccctgggctgcctggtcaaggactacttccatctacactactgagcgggctggcaaggcgcatagnn

SEQ ID NO: 200262 - DNA, 695 bp, Homo sapiens
  misc_feature: GYAE6OF02HO00N.37.86.H09.1.454.CMB.1.raw
tcagtagtgtagatcacgaccggtgctcgatttagtgctatagacttgggtttgggggaagaggaagactgacggtcccccaggagttcaggtgctgggcacggtgggcatgtgtgagttttgtcacaagatttgggctcaacttctcctgtcgcagtcctctgggatttcacctttaatacctagttggatggagttggtccgccaggttccacgggaagggctggagtgggtggccaacgactaaacgcctaagatggaagtggagaaatactactggtaggaaccttcgtaggtacgaaaggggtccccggaaagtttccgaacccgagtaccgtccccgaaggtacggaccaaaccgggcccccaacggtaaaccgtcgtaacttacggtaactccgttgaccgtaaaaggtaggaaaccgtagtacgtacgaaggacgcccggaaggaacggtccgggtcgtacggtggtaacttaacgtgtacgtccgaaggacgtacgggtaggcgtagttaggtacggtaaagtgggtacgtagggtccttcgttaactactacttactacagtcggacgtcgtgggacaaacgggaccacggtcaccgtctcctcgacgcctaccaccgacgggccctagtccggtccttccccgtgccctaccctcctaccgaagccgacctaccgtcgtcgggg

SEQ ID NO: 200263 - DNA, 173 bp, Homo sapiens; identical to SEQ ID NO: 200127
  misc_feature: GYAE6OF02FNG5Z.37.86.H09.1.454.CMB.1.raw
  modified_base (173)..(173): a, c, t, g, unknown or other
  misc_feature (173)..(173): n is a, c, g, or t

SEQ ID NO: 200264 - DNA, 174 bp, Homo sapiens; identical to SEQ ID NO: 200128
  misc_feature: GYAE6OF02I5824.37.86.H09.1.454.CMB.1.raw
  modified_base (173)..(174): a, c, t, g, unknown or other
  misc_feature (173)..(174): n is a, c, g, or t

SEQ ID NO: 200265 - DNA, 174 bp, Homo sapiens; identical to SEQ ID NO: 200128
  misc_feature: GYAE6OF02FJVHE.37.86.H09.1.454.CMB.1.raw
  modified_base (173)..(174): a, c, t, g, unknown or other
  misc_feature (173)..(174): n is a, c, g, or t

SEQ ID NO: 200266 - DNA, 174 bp, Homo sapiens; identical to SEQ ID NO: 200201
  misc_feature: GYAE6OF02ILRXF.37.86.H09.1.454.CMB.1.raw
  modified_base (174)..(174): a, c, t, g, unknown or other
  misc_feature (174)..(174): n is a, c, g, or t

SEQ ID NO: 200267 - DNA, 173 bp, Homo sapiens
  misc_feature: GYAE6OF02HBDQ8.37.86.H09.1.454.CMB.1.raw
  modified_base (173)..(173): a, c, t, g, unknown or other
  misc_feature (173)..(173): n is a, c, g, or t
tcagtagtgtagatcacgaccggtgctcgatttagtgctatagacttgggtttgggggaagaggaagactgacggtcccccaggagttaaggtgctgggcacagcggccctgggctgcctggtcaaggactacttccatctacactactgagcgggctggcaaggcgcatagn

SEQ ID NO: 200268 - DNA, 191 bp, Homo sapiens
  misc_feature: GYAE6OF02H6SZ6.37.86.H09.1.454.CMB.1.raw
  modified_base (174)..(191): a, c, t, g, unknown or other
  misc_feature (174)..(191): n is a, c, g, or t
tcagtagtgtagatcacgaccggtgctcgatttagtgctatagacttgggtttgggggaagaggaagactgacggtccccccaggagttcaggtgctgggcacagcggccctgggctgcctggtcaaggactacttccatctacactactgagcgggctggcaaggcgcatagnnnnnnnnnnnnnnnnnn

SEQ ID NO: 200269 - DNA, 520 bp, Homo sapiens
  misc_feature: GYAE6OF02FMD2A.37.86.H09.1.454.CMB.1.raw
  modified_base (200)..(200): a, c, t, g, unknown or other
  misc_feature (200)..(200): n is a, c, g, or t
  modified_base (298)..(298): a, c, t, g, unknown or other
  misc_feature (298)..(298): n is a, c, g, or t
  modified_base (396)..(396): a, c, t, g, unknown or other
  misc_feature (396)..(396): n is a, c, g, or t
tcagtagtgtagatcacgaccggtgctcgatttagtgctatagacttgggtttgggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggctcctcatctatggtncatccaccagggccactggtactcccagccaggttcagtggcaggtgggtctgggacagagttcactctcaccatcagcagcctgcagtctagaagtntttgcttactttattactgtcagcagtataatacgtcggcccggtacgttcgaccgaaggaccgaagggtacggaatacgaaacgaactggtacggctgacacgtactcgtgttcttctatccg

SEQ ID NO: 200270 - DNA, 506 bp, Homo sapiens
  misc_feature: GYAE6OF02GWP49.37.86.H09.1.454.CMB.1.raw
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgctaactttattactgtcagcacttataagtgggatacgttcggccgagggaccgtagggttgagatacgaaacggtactggtggctgcaccatctgtcttcattccg

SEQ ID NO: 200271 - DNA, 178 bp, Homo sapiens; identical to SEQ ID NO: 200250
  misc_feature: GYAE6OF02GYXRJ.37.86.H09.1.454.CMB.1.raw
  modified_base (173)..(178): a, c, t, g, unknown or other
  misc_feature (173)..(178): n is a, c, g, or t

SEQ ID NO: 200272 - DNA, 175 bp, Homo sapiens
  misc_feature: GYAE6OF02IICZA.37.86.H09.1.454.CMB.1.raw
  modified_base (172)..(175): a, c, t, g, unknown or other
  misc_feature (172)..(175): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactacgagcgggctggcaaggcgcatagnnnn

SEQ ID NO: 200273 - DNA, 580 bp, Homo sapiens
  misc_feature: GYAE6OF02HBWQM.37.86.H09.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (307)..(307): a, c, t, g, unknown or other
  misc_feature (307)..(307): n is a, c, g, or t
  modified_base (361)..(361): a, c, t, g, unknown or other
  misc_feature (361)..(361): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagcccaccctgtctgtgtctccagggggaaanagccaccctctcctgcagggccagtcagagtgttagcagcaacttagcctggtaccagcagaacctggccaggcctcccagctcctcatcatggtncatccacngggccactggtactcccgagcctaggttcaggtggctagggtcgggctgggacnggtagttcactccgtacacctatccagtccacgcctgctagtctagaagttagtttgacttaactttattactgtcagtactaagttaataacgtaaccgtcgggaccccggtacggttccggaccgtaaacgggacgtaagggtaggaataccgaacggaacgttaggtacggactacgacctaccgtacttcgttcgttaccttacgtacttacccg

SEQ ID NO: 200274 - DNA, 176 bp, Homo sapiens; identical to SEQ ID NO: 200163
  misc_feature: GYAE6OF02IG998.37.86.H09.1.454.CMB.1.raw
  modified_base (173)..(176): a, c, t, g, unknown or other
  misc_feature (173)..(176): n is a, c, g, or t

SEQ ID NO: 200275 - DNA, 255 bp, Homo sapiens
  misc_feature: GYAE6OF02FKJEJ.37.86.H09.1.454.CMB.1.raw
  modified_base (253)..(255): a, c, t, g, unknown or other
  misc_feature (253)..(255): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggcaccctcctccaagagcacctctgggggcacagcggccctgggctgcctggtcaaggctacttccatctacactactgagcgggctggcaaggcgcatagnnn

SEQ ID NO: 200276 - DNA, 880 bp, Homo sapiens
  misc_feature: GYAE6OF02IXK9Z.37.86.H09.1.454.CMB.1.raw
tcagtagtgtagatcacgaccggtgctcgatttagtgctatagacttgggtttgggggaactggctcagttaggacccagacggaaccatggaagccccagcgcagcttactcttcctcctgtacctcctcggtcgtccctacgagtaccctacctacggtacgggaaaacttaaaacgttaggtaccgaacgtcgaacggtccttaccgacgtccccaaccgtcgtaccctggttcgtccgtcgaacggggtaacacgggaaccaccggttcctcccgtagacctacgggaccctcgggtaccaacggtcggttacgttaacggtcctaggaccctaacggttacgaccccgttagggacccgtacggtaccgaacgtaaccgtacggacccgtacggaccgtaccggtaccgtacccgtccgtaccgtacctaacctacgtcgtaccgtacgaccgtaccgtacgtccaaccgtccgggtacctacccggttaccggtacgtcccggtacggtaccgtagggttccgacggttacgggtaccggtacggtacgggtaccgtacgggtaacttaccgtaacgttaccgtaccgtacccgtactaccgacgtccgaacgtcccgtacggtaccgtacggtaccgttacggtaaccttacgtttaccgtaccgtttaacggtttactttacgttacgttacgttaacgtacgtaacgttaacgttaacgttaaccgtaccggtaccggtaccggaaccgtttacgggtaccgtaaacgggtaccgaacggtacgtaacgttaccgtaaccggtaacgtaccgttacggaacgttcgtaccgtaccctacgtacccttacggtcccttaccgttaccgtacc

SEQ ID NO: 200277 - DNA, 609 bp, Homo sapiens
  misc_feature: GYAE6OF02HFN30.37.86.H09.1.454.CMB.1.raw
  modified_base (201)..(201): a, c, t, g, unknown or other
  misc_feature (201)..(201): n is a, c, g, or t
  modified_base (411)..(411): a, c, t, g, unknown or other
  misc_feature (411)..(411): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccagtcagagtgttagcagcaacttagcctggtaccagcagaaacctggccaggctcccaggcctcctcactctatggtgcactcccaccgagggccacgtggtactcccagcccaggttcaggtgctaggtgggtctgggacagagttccacttctccactatcagcacgcctgctagtctagaagttntttcgacttacttttattactgtacagtacctaagttaacttaaactaccgtccgggaccccgtaacggtttccggaccgtaaacgggaaccgtaaggggttaacggaaacttaaccggaaaaccggtaacgttaggtacgggtacctacggaccctaaccgtacgtccgttagttaccctttaccacgtttcccccg

SEQ ID NO: 200278 - DNA, 172 bp, Homo sapiens
  misc_feature: GYAE6OF02I403M.37.86.H09.1.454.CMB.1.raw
  modified_base (172)..(172): a, c, t, g, unknown or other
  misc_feature (172)..(172): n is a, c, g, or t
tcagtagtgtagatcacgaccggtgctcgatttagtgctatagacttgggtttgggggaagaggaagactgacggtccccccaggagttcaggtgctgggcacagcggccctgggctgcctggtaggactacttccatctacactactgagcgggctggcaaggcgcatagn

SEQ ID NO: 200279 - DNA, 647 bp, Homo sapiens
  misc_feature: GYAE6OF02JA9B2.37.86.H09.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcagggccagtcagagtgttagcagcaacttagcctggtaccagcagaaacctggccaggctccccaggctcctnatctatggtgcatccaccgtacgggccacgtcggtactcccgagcctaggttcaggtggcgaggttcgggtcgtagggacaggtacgttccaccttctaccacctatcgagcacgcctggcgtacgttcgtacggtaaagttcgttttcgactttacttttaacgttacgttgtacgtagtacgtaagttaacttaacgttaaccgtccgggtaccccggttaacggtaccggtaccggaaacgggtaaccgtaagggtaacggtaaacgttaccggtaaaccggtaacggttacggtacggtacgtaccgaccgtaaccgtacgttacgttaccgtcgtttacctcgttaccccg

SEQ ID NO: 200280 - DNA, 175 bp, Homo sapiens
  misc_feature: GYAE6OF02FQFO6.37.86.H09.1.454.CMB.1.raw
  modified_base (175)..(175): a, c, t, g, unknown or other
  misc_feature (175)..(175): n is a, c, g, or t
tcagtagtgtagatcacgaccggtgctcgatttagtgctatagacttgggtttggggggaagaggaagactgacggtccccccaggagttcaggtgctgggcacagcggccctgggctgcctggtcaaggactacttccatctacactactgagcgggctggcaaggcgcatagn

SEQ ID NO: 200281 - DNA, 184 bp, Homo sapiens
  misc_feature: GYAE6OF02GATLS.37.86.H09.1.454.CMB.1.raw
  modified_base (165)..(165): a, c, t, g, unknown or other
  misc_feature (165)..(165): n is a, c, g, or t
  modified_base (171)..(184): a, c, t, g, unknown or other
  misc_feature (171)..(184): n is a, c, g, or t
tcagtagtgtagatcacgaccggtgctcgatttagtgctatagacttgggttgggggaagaggaagactgacggtcccccaggagttcaggtgctgggcacagcggccctgggctgcctggtcaaggactacttccatctacactactgagcggctggcaaggcncatagnnnnnnnnnnnnnn

SEQ ID NO: 200282 - DNA, 175 bp, Homo sapiens
  misc_feature: GYAE6OF02GCBPN.37.86.H09.1.454.CMB.1.raw
  modified_base (172)..(175): a, c, t, g, unknown or other
  misc_feature (172)..(175): n is a, c, g, or t
tcagtagtgtagatcacgaccggtgctcgatttagtgctatagacttgggtttgggggaagaggaagactgacggtcccccaggagttcaggtgctgggcacagcggccctgggctgcctggtcaaggactacttccatctacactctgagcgggctggcaaggcgcatagnnnn

SEQ ID NO: 200283 - DNA, 267 bp, Homo sapiens
  misc_feature: GYAE6OF02IBQN2.37.86.H09.1.454.CMB.1.raw
  modified_base (259)..(267): a, c, t, g, unknown or other
  misc_feature (259)..(267): n is a, c, g, or t
tcagtagtgtagatcacgaccggtgctcgatttagtgctatagacttgggtttgggggaattatcgttatggtgctttgatatctggggccaagggacaatggtcaccgtctcttcagcctcaccaagggcccatccggtcttccccctggccaccctcctcccaagacgccaccctcgtcgggggcacagccggccctgggctgcctgtcaaggctacttccatctacactactgagcgggctggcaaggcgcatagnnnnnnnnn

SEQ ID NO: 200284 - DNA, 596 bp, Homo sapiens
  misc_feature: GYAE6OF02HI9CI.37.86.H09.1.454.CMB.1.raw
  modified_base (201)..(201): a, c, t, g, unknown or other
  misc_feature (201)..(201): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagccaccctgtctgtgtctccaggggaaanacgccaccctctcctgcagggccagtcagagtgttagcagcaacttagcctggtaccagcaagaaacctggccaggcctcccgaggcctcctcatctagtggtgccatcccaccgagggcccacgtcggtactcccgagccgtaggttcaggtcggcgtaggtcgggtctagggacaggtacgttcacgtctaccacctagtccagccacgcctgccagtcagtaacgttatttggacttagtttacttctgtcagtactaagttataagttcgtcgtccttacgttacggtcggtaccggttaccggaccgtaacgggtaccgtaagggtacggtaaactaccgaaaacgtacgttacgtacggacctacggaccctacgtacttcgtgttacc

SEQ ID NO: 200285 - DNA, 261 bp, Homo sapiens
  misc_feature: GYAE6OF02FV3XX.37.86.H09.1.454.CMB.1.raw
  modified_base (255)..(261): a, c, t, g, unknown or other
  misc_feature (255)..(261): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtcttccccctggcaccctcctccaagagcacctccgagagcacagcggccctggggctgcctggtcaaggactacttccatctacactactgagcgggctggcaaggcgcatagnnnnnnn

SEQ ID NO: 200286 - DNA, 270 bp, Homo sapiens
  misc_feature: GYAE6OF02FF0JA.37.86.H09.1.454.CMB.1.raw
  modified_base (256)..(270): a, c, t, g, unknown or other
  misc_feature (256)..(270): n is a, c, g, or t
tcagtagtgtagatcacgaccggtgctcgatttagtgctatagacttgggtttgggggaattatcgttatggtgctttgatatctggggccaagggacaatggtcaccgtctcttcagcctccaccaagggcccatccggtcttccccctggccaccctcctccaagagccacctctggggcacagccggccctgggctgcctggtacaaggactacttccatctacactactgagcggctggcaaggcgcatagnnnnnnnnnnnnnnn

SEQ ID NO: 200287 - DNA, 174 bp, Homo sapiens; identical to SEQ ID NO: 200201
  misc_feature: GYAE6OF02FWL54.37.86.H09.1.454.CMB.1.raw
  modified_base (174)..(174): a, c, t, g, unknown or other
  misc_feature (174)..(174): n is a, c, g, or t

SEQ ID NO: 200288 - DNA, 902 bp, Homo sapiens
  misc_feature: GYAE6OF02IQC5X.37.86.H09.1.454.CMB.1.raw
  modified_base (246)..(246): a, c, t, g, unknown or other
  misc_feature (246)..(246): n is a, c, g, or t
tcagtagtgtagatcacgaccggtgctcgatttagtgctatagacttgggtttggggggaacgggtgctacaggttaggacccagacggaaccagtgggaagcccccaagcgcgagcgttctcttcctcctgccttacctctcggcctcccagactaccgaacctgggaaggaaactaggtcgattgacgcctaggtcctccagcccaccctgtcctgtcgtcgtccaggggaagacgccaccctntcctgcagggcccagtccaggtcgtacgttacgcagactaacgttggcctaggtaccagtctaacgaaccgttggaccacggacctaccccgaggcctacccctaacgaccttacctaagttcgggttatacgacttacccgaaccgaacggggccctaacggttccgttaacgtcccggtagcccgttaagggttcctacggttcggcgtacgggttccgggtacgtacggggaacctaaggttaccggtttacccacccgttaccgtacccaaacccgtagtttacccggacggtaccctaaccggtacccggttacggaccggtaaccggtttaccggtaaggtaaaccgtttaacgttttttaccgttaaccgttttaacgttttttaacggtttacccttacggtttaacccgaaggttacccgttaaagtttaaacggttttaaaccgtttaaaccggggttcccggggtttacccccggggttaaccggggtttccggggaaaccccgggtaaaggggtaaacccgtaacggggttaacggtaaccgtaaccggtaaaccgggttacgtacggggtaacggtccgtaccggtaaccctacccggttacttaccgttccggttaacctttcccgtaacccgttttccccg

SEQ ID NO: 200289 - DNA, 280 bp, Homo sapiens
  misc_feature: GYAE6OF02IAXTL.37.86.H09.1.454.CMB.1.raw
  modified_base (142)..(142): a, c, t, g, unknown or other
  misc_feature (142)..(142): n is a, c, g, or t
  modified_base (253)..(280): a, c, t, g, unknown or other
  misc_feature (253)..(280): n is a, c, g, or t
tcagtagtgtagatcacgaccggtgctcgatttagtgctatagacttgggtttgggggaattatcgttatggtgcttttgatatctggggccaagggacaatggtcaccgtctcttcagcctccaccaagggcccatcggtnttccccctggcaccctcctccaagagcacctctggggcacagcggccctgggctgcctggtcaaggactacttccatctacactactgagcgggctggcaaggcgcatagnnnnnnnnnnnnnnnnnnnnnnnnnnnn

SEQ ID NO: 200290 - DNA, 619 bp, Homo sapiens
  misc_feature: GYAE6OF02H5OUW.37.86.H09.1.454.CMB.1.raw
  modified_base (204)..(204): a, c, t, g, unknown or other
  misc_feature (204)..(204): n is a, c, g, or t
  modified_base (319)..(319): a, c, t, g, unknown or other
  misc_feature (319)..(319): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
  modified_base (612)..(612): a, c, t, g, unknown or other
  misc_feature (612)..(612): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagcccaccctgtctgtcgtctccgaggggaaanagcccacctctcctgcagggccagtcagagtgttagcagctaacttgcctggtaccagcaagaactggccaggcctcccgaggcctcctcatcctagtcggtgccatcccaccgngggccctagtggtactccgagccgtagttcagtggctaggtggtctgggaactaggtcgttcacgttccncgaacctntacaggcacgccttgactaggttcgagaacgtttnttttagggacttaaggttttttactcggttacgtcacggtaccttaagttaacttacgtttcgaccggtccttaaccggttacggtcggttacggttaccgaccggaagggtaccctaagggtagtaactaacgaaaacggtcttgggtacgtgtaccgacttaccggtattacccggtntttcccg

SEQ ID NO: 200291 - DNA, 756 bp, Homo sapiens
  misc_feature: GYAE6OF02HGB2A.37.86.H09.1.454.CMB.1.raw
  modified_base (149)..(149): a, c, t, g, unknown or other
  misc_feature (149)..(149): n is a, c, g, or t
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactgganaaatagtgatgacgcagtctcagcccacctgtctgtntctaccgaggggaaangcccacctctccgtgcagggccagtcagtagtgttagcagactaacgttacgccttaggtaccagaccaacgaaacctggaccgaggccncccgaaggcctactcacttactagtcggtnacctactccaaccggtacggcctagtcggactacccgagtccgtaggtacacggtacgacgtaggtgggtactagggactacggtatcgtactctaccgactacgtcgaacgtccaaccggtcgtacgtaccgtaagttacgtaacggtaaagtttacgttttaccgaacctttttaacttttacggttacctttaaggtacccgtaaagtacgtttaaaggttaaaccgttaaacctttaaccggggtcccggtaacccgggtaacggttaaccccgggtaaacggtaaaccgggtaaaccgttaaacggggtaacggtaaaccgtaaacggtaaaccccggtaaggttaaccgggtccgtaacggttaccgaaaccgtaaccgttacggttaccttaccgggtttaacttacccggttaccgtttaccccgg

SEQ ID NO: 200292 - DNA, 182 bp, Homo sapiens
  misc_feature: GYAE6OF02IWPXP.37.86.H09.1.454.CMB.1.raw
  modified_base (175)..(182): a, c, t, g, unknown or other
  misc_feature (175)..(182): n is a, c, g, or t
tcagtagtgtagatcacgaccggtgctcgatttagtgctatagacttgggtttggggggaagaggaagactgacggtccccccaggagttcaggtgctgggcacagcggccctgggctgcctggtcaaggactacttccatctacactactgagcgggctggcaaggcgcatagnnnnnnnn

SEQ ID NO: 200293 - DNA, 693 bp, Homo sapiens
  misc_feature: GYAE6OF02HKXMK.37.86.H09.1.454.CMB.1.raw
  modified_base (676)..(676): a, c, t, g, unknown or other
  misc_feature (676)..(676): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcgagggccagtcagagtgttagcagctaacttacgccgtaggtaaccagcaacgaaaccgtcggaccaccggcccccgaggcctcctcactctacgtcgctcggtccttacccgtcgacgggtaccacgtcggactaccgtcccgacgtccgtacggttcacggtcgggacgtaggtcggggttactaggaacgtacgtacgtacctttcaccgttcctaccgaacctacgtacgaacggtactaacgttacgtacgggtaccgtaccgtagtaaacggtttagttttcgacctttaaacttttacgtacttacgtacgttaaccaaacgtcgtaccgttaccaccgtaccggttcgggttaccgtacccgttacgggaacccgtaaacggggtaccgtaaacgggttcggtaacctttaccggtaacggtacgttggtacgcgtacgacgtaaccgtnttcgttctccgtatccg

SEQ ID NO: 200294 - DNA, 650 bp, Homo sapiens
  misc_feature: GYAE6OF02GAXZL.37.86.H09.1.454.CMB.1.raw
  modified_base (265)..(266): a, c, t, g, unknown or other
  misc_feature (265)..(266): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (358)..(358): a, c, t, g, unknown or other
  misc_feature (358)..(358): n is a, c, g, or t
tcagtagtgtagatcacgaccggtgctcgattttagtgctatagacttgggggtttgggggggaattatcgttatggtgcttttgatagtctggggccaagggacaatggtccaccgtctcttcagcctccaccaagggtcccatcggtcttccccctgggcgccctggctccgaggagcacctccgagagcacagcggccctgggcctgccgtggtcaaggctacttccatctacatactgagcgggctggacaggcacatagnngntacntntatcngtnacngacgnactcgnaactccaggatatctggttnacgtntactacgacgtcgtcgtagtcgtacagtacgtagtcncgtacgtgacgtagacgtgagtactactactcggactacctaggacgtctacgtacgtacgtacgtacggtacgtacggtacggtacggtacggttacgtacttacgttacgttacgtcgtacgtacgtacgtacgttacgttacgttacgttacggttaaccggttaccggtaccgttacgttacggtttagttacggttaacggtacggtaacggttaaccggtaacggttaccgttacggtacggtacggtaaccgtaccgttaccgtaccggtaccgttaccgtaccg

SEQ ID NO: 200295 - DNA, 187 bp, Homo sapiens
  misc_feature: GYAE6OF02I01Y7.37.86.H09.1.454.CMB.1.raw
  modified_base (175)..(187): a, c, t, g, unknown or other
  misc_feature (175)..(187): n is a, c, g, or t
tcagtagtgtagatcacgaccggtgctcgatttagtgctatagacttgggtttgggggaagaggaagactgacggtccccccaggagttcaggtgctgggcacagcggccctgggctgcctggtcaaggactacttccatctacactactgagcgggctggacaaggcgcatagnnnnnnnnnnnnn

SEQ ID NO: 200296 - DNA, 196 bp, Homo sapiens
  misc_feature: GYAE6OF02JVGAP.37.86.H09.1.454.CMB.1.raw
  modified_base (168)..(168): a, c, t, g, unknown or other
  misc_feature (168)..(168): n is a, c, g, or t
  modified_base (173)..(196): a, c, t, g, unknown or other
  misc_feature (173)..(196): n is a, c, g, or t
tcagtagtgtagatcacgaccggtgctcgatttagtgctatagacttgggtttggggggaagaggaagactgacggtccccccaggagttcaggtgctgggcacagcggccctgggctgcctggtcaaggctacttccatctacactactgagcgggctggcaaggcnatagnnnnnnnnnnnnnnnnnnnnnnnn

SEQ ID NO: 200297 - DNA, 229 bp, Homo sapiens
  misc_feature: GYAE6OF02HNFKK.37.86.H09.1.454.CMB.1.raw
  modified_base (171)..(171): a, c, t, g, unknown or other
  misc_feature (171)..(171): n is a, c, g, or t
  modified_base (177)..(180): a, c, t, g, unknown or other
  misc_feature (177)..(180): n is a, c, g, or t
  modified_base (183)..(184): a, c, t, g, unknown or other
  misc_feature (183)..(184): n is a, c, g, or t
  modified_base (188)..(229): a, c, t, g, unknown or other
  misc_feature (188)..(229): n is a, c, g, or t
tcagtagtgtagatcacgaccggtgctcgatttagtgctatagacttgggtttggggggaacaggaagactgacggtccccccaggagttcaggtgctgggcacagcggccctgggctgcctggtcaaggactacttccatctacactactgagcgggctggacaaggtcncatagnnnncanngctnnnnnnnnnnnnnnnnnnnnnnnnnnnnnnnnnnnnnnnnnn

SEQ ID NO: 200298 - DNA, 177 bp, Homo sapiens
  misc_feature: GYAE6OF02H8V6Q.37.86.H09.1.454.CMB.1.raw
  modified_base (175)..(177): a, c, t, g, unknown or other
  misc_feature (175)..(177): n is a, c, g, or t
tcagtagtgtagatcacgaccggtgctcgatttagtgctatagacttgggtttggggggaagaggaagactgacggtccccccaggagttcaggtgctgggcacagcggccctgggctgcctggtcaaggactacttccatctacactactgagcgggctggcaaggcgcatagnnn

SEQ ID NO: 200299 - DNA, 207 bp, Homo sapiens
  misc_feature: GYAE6OF02HMYWR.37.86.H09.1.454.CMB.1.raw
  modified_base (176)..(207): a, c, t, g, unknown or other
  misc_feature (176)..(207): n is a, c, g, or t
tcagtagtgtagatcacgaccggtgctcgatttagtgctatagacttgggtttgggggggaagaggaagactgacggtccccccaggagttcaggtgctgggcacagcggccctgggctgcctggtcaaggactacttccatctacactactgagcgggctggcaaggcgcatagnnnnnnnnnnnnnnnnnnnnnnnnnnnnnnnn

SEQ ID NO: 200300 - DNA, 802 bp, Homo sapiens
  misc_feature: GYAE6OF02GRRXX.37.86.H09.1.454.CMB.1.raw
  modified_base (207)..(207): a, c, t, g, unknown or other
  misc_feature (207)..(207): n is a, c, g, or t
  modified_base (540)..(540): a, c, t, g, unknown or other
  misc_feature (540)..(540): n is a, c, g, or t
tcagtagtgtagatcacgaccggtgctcgatttagtgctatagacttggggtttggggggaactgctcagttaggacccagacggaaccatggaagccccagcgcagcttctcttcctcctgctactctggctcccagactaccactggagaaatagtgatgacgctagtcctccagcccaccctgtctgtgtctccgaggggaaancgccaccctctcctgcgacgggccctagtcgagtaggttgttaagctagacctaacgttaggcccgttgggaaccaggtaccaaacggaaacccgtcgggacccacgggaccttaccccgaggtcctacccgtacctaactttctaggtggtcggacctacctacccgaccggaccgggtaccctacgttacgtaccgtacccgacggtccgtaacgggttcgtaggtcggaccgtaggggttcggtcggtacgggacaggtacgttccacgttcctacaccgtactacgacgaccgtacgtccgagtaccgtcgtacggtagtaacggtttnttttaccgtaacctttacgtttttaacgttaccggttagttaacccgacgttaacgttaaacgttaaacgttaacgttaaacccgggtcccggggtaacccgggttacccgggttaaccggtaaacccgggtaaacggggttaaaccgtaaggggttaaccggaaaccgttaacggtaaaccgggtaagttaccggtacgggtacccgtacgtaaccgttacaccggtttccttagttacccttacggttacccttaccccg

SEQ ID NO: 200301 - DNA, 840 bp, Homo sapiens
  misc_feature: GYAE6OF02FL2U4.37.86.H09.1.454.CMB.1.raw
  modified_base (202)..(202): a, c, t, g, unknown or other
  misc_feature (202)..(202): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagataccacgtggagtaaatagtgatggacgcagtctcagccaccctgtctgtgtctcgaggggaangccacctctcctgcacggggccacgtcaggtacgttgttaacgcgtagacctaaacttacggcccttaggtaccagccgtaacgtaaaccgttcggacctacggccgttccccgaaggcctcctacctacgttaccgtacgttcggtcgaccaacgttccccgaacggtacgggtaccctaacgttcggttaacctcccgacgtacccgttacggttaccgtacggtacgggaccgttagggttccgggggttcgtttacgggggaaaccttaaggggtaccgttttacccgtaaccgtttacccgttaccggaaacccttgttaccgacgggtacccgtacggtccccgttacggtacccgttacgttccgtaaacgggttaaacgttttcgttttccgtaccttttaaacgtttttcctttaaccgttacggttcgtaacggttacttaacggttaaacgttaaacgttacccgggtacccgggttaaccccgggtacgggtttacccgggaaccggtaaccgggtaaccggaaagggttaccggtaaaacgtacggtaaaccggtaacggttccggtacggcgttacccgaccgttacaacgttccggtactttccttaccggtacccttcccgg

SEQ ID NO: 200302 - DNA, 241 bp, Homo sapiens
  misc_feature: GYAE6OF02HJ5PC.37.86.H09.1.454.CMB.1.raw
  modified_base (64)..(64): a, c, t, g, unknown or other
  misc_feature (64)..(64): n is a, c, g, or t
  modified_base (177)..(241): a, c, t, g, unknown or other
  misc_feature (177)..(241): n is a, c, g, or t
tcagtagtgtagatcacgaccggtgctcgatttagtgctatagacttggggtttgggggggaanaggaagactgacggtccccccaggagttcaggtgctgggccacagcggccctgggctgcctggtcaaggactacttccatctacatactgagcgggctgacaggcgtcatagnnnnnnnnnnnnnnnnnnnnnnnnnnnnnnnnnnnnnnnnnnnnnnnnnnnnnnnnnnnnnnnnn

SEQ ID NO: 200303 - DNA, 784 bp, Homo sapiens
  misc_feature: GYAE6OF02JOT5K.37.86.H09.1.454.CMB.1.raw
tcagtagtgtagatcacgaccggtgctcgatttagtgctatagacttgggtttgggggggaactgctcagttaggacccagacggaaccatggaagccccagcgcagcttctcttcctcctgctactcgtggcctcccagtactaccacgtagggagaaatagtgagtggaccgcagttctaccgacgaccctaccctgtcttagtgtctaccggaaggggtaacacgcccctacccgtcctccgtcggacgcgggactacgtacgagtagttagtacgacacgtacaacggttcgaccgtacggtacgacgacgtaacgaaccgtacgaccgtaaccggcctaccggacggtcctaccgtactacgtactagtcggtaccacgtaccgacccgaccggtaccgggtccttacggaccggttacctacccgtaacgtaccgtacggtacgtacggtcgggtacgtacgggtacggtacgggtaacggacgtaacggttacgtaccgtacgttaccgtaccgtacgtacgtacgtacgtaccgacgtacggtaccgtcgttcgtacgttacggttacgtttccttacgttactttaacgtttacgttacgtcgtactaacgtcgtaaattaacctttaccggtaccggtacccggtaccggtaccgttacggtaaccggtacggtaacgggtaaccgtaaccggtagtaaccttaaccggacggttaacgtcggtactaccggtactacggttactacgttcgttacgtccgttacccgtacccg

SEQ ID NO: 200304 - DNA, 880 bp, Homo sapiens
  misc_feature: GYAE6OF02FGVQH.37.86.H09.1.454.CMB.1.raw
  modified_base (326)..(326): a, c, t, g, unknown or other
  misc_feature (326)..(326): n is a, c, g, or t
  modified_base (387)..(387): a, c, t, g, unknown or other
  misc_feature (387)..(387): n is a, c, g, or t
tcagtagtgtagatcacgaccggtgctcgatttagtgctatagacttgggtttggggggaactgctcagttaggacccagacggaaccatggaagccccagcgcagcttctcttcctcctgctactctggctcccagactaccactggagaaatggtgatgacgcagtctccagccaccctgtctgtcgtctaccgaggggaaatcgccaccctctcctgctacgggccagtcaggtacgtgttagcgagacctaaccgtttcggccctggtaaccaggaccaagaaacccgttggccgtaacggcctacccgacggccttccctntagttgtacgtggtacgtactactacccaccggtacgggaccctaacggtcggttaacccncccgtaaccggtaccgtacggtttaccgacggttacggcccggtaaggttaccgggggtaaccggtacggggtaaccgttagggtaaaccggtttccgtaaacggttaaccccgtaaacgtacgttaccgaacggtacgtaacccggtccgttacgggaccgtaacccgggttacggttaaacggttaaacggtttacgttttacggggttaaacttttttacggtttccggttaaggtttaccggaacgttacggttaagggttttaacccgttacggttttacccggaccgggtttaccccggttaacggggtttaccccggtttaccgggaacccccgtaaacggggttaaaacccggtaacggggttaccgaaaacccgttaaccggtaaacccggtacgtttacgggtaccggccggtaaacgtcccgtaacccgttcgtttaaccgggtacctttacccggtaccttacccttccccggttaacccc

SEQ ID NO: 200305 - DNA, 254 bp, Homo sapiens
  misc_feature: GYAE6OF02IO27P.37.86.H09.1.454.CMB.1.raw
  modified_base (186)..(186): a, c, t, g, unknown or other
  misc_feature (186)..(186): n is a, c, g, or t
  modified_base (189)..(254): a, c, t, g, unknown or other
  misc_feature (189)..(254): n is a, c, g, or t
tcagtagtgtagatcacgaccggtgctcgatttagtgctatagactttggggtttgggggggaaagaggaagactggaccggtccccccaggagttcaggtgcgtgggcacagcggccctgggctgcctggtcaaggactcttccatctacactactggagcgggctggccaagggcgacagtagnagnnnnnnnnnnnnnnnnnnnnnnnnnnnnnnnnnnnnnnnnnnnnnnnnnnnnnnnnnnnnnnnnnn

SEQ ID NO: 200306 - DNA, 754 bp, Homo sapiens
  misc_feature: GYAE6OF02IVXV4.37.86.H09.1.454.CMB.1.raw
  modified_base (164)..(164): a, c, t, g, unknown or other
  misc_feature (164)..(164): n is a, c, g, or t
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (571)..(571): a, c, t, g, unknown or other
  misc_feature (571)..(571): n is a, c, g, or t
tcagtagtgtagatcacgaccggtgctcgatttagtgctatagacttgggtttgggggggaactgctcagttaggacccagacggaaccatggaagccccagcgcagcttctcttcctcctgctactctggctcccagactaccactggagaatagtgatgacncagtctccagccaccgtgtctgtgtctccgaagggaacncgccaccctntactgacgacggccaggtcagtagttgttanctagacctagttacgccttaggtaccacgactaagaaccgtaggccgtacggccctaccgacggtccttacctctacttacgttacgttcgggtctacgtacctacccgaccggtacgggtaccctacgggttccgtaacgtccccgtaacggtaccgtacgggttaccgtacggtaggtacccggttaggggttaccggggttacgtaaccggggtaccggtaggttaaacccggttccgtaccgtccttacccgtaaccgtaacgtccgaacggtccgtaacgtccgtacggtacgtacgtcggtaacggttagttaaccgtttnaaccgtttactttacgtcgtagtcgtagtcctaagttaactacgtaccggtaccgtacccggtgtaccgtacggacggtaacggtacgggttaacgtactaacggtaaccgaacgttaccggtcggtaacgttacccgtaccgtacgtacgttaccgtacgtaaccgtttcgaccgttacccg

SEQ ID NO: 200307 - DNA, 229 bp, Homo sapiens
  misc_feature: GYAE6OF01CNDEQ.25.78.H01.1.454.CMB.1.raw
  modified_base (213)..(229): a, c, t, g, unknown or other
  misc_feature (213)..(229): n is a, c, g, or t
tcagactgtacagtcacgaccggtgctcgatttagtgtgagtagtttgggtttgggtgcccaagctgctggagggcacggtcaccacgctgctgagggagtagagtcctgaggactgtaggacaggccgggaaggtgggcacagcggccctgggctgcctggtcaaggactacttccactgtacagtctgagcgggctggcaaggcgcatagnnnnnnnnnnnnnnnnn

SEQ ID NO: 200308 - DNA, 603 bp, Homo sapiens
  misc_feature: GYAE6OF01AZYHS.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattgggctggatccggcggcccccgggaaggcctggagtggttgggcagtgtccaatacggtagacctccccactaccgccccatccctcgaggggtcgcctcacgttgtcaattgacacctctaagaagcagttctctctgggtctgacttctgtcaccgccgcggacacggccacatactattgtgtctcggacacgatcgggccacgtaccttacccctttctctacgtggggcccgggtaatccggtaggtccaccgtcctcctcgacgccctaccaccgaacgggccccagttcccgggtcccttccccccgtgggtacccctacccccgttcctcccaaaggccgtacccg

SEQ ID NO: 200309 - DNA, 669 bp, Homo sapiens
  misc_feature: GYAE6OF01CEU0P.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattgggctggatccggcggcccccggaaggcctggagtggttgggcagtgtccaatacggtagacctcccactacgccccatccctcaggggtcgcctcacgttgtcaattgaccactctaaagaagcagttctctctgggtctgacttctgtcaccgcgcggacacggcacgtatactattgtcgtctcggactacgagtcgggaccgtaccggtaccttaaccccttttctcgttaaccgtcgggggacccgggggtaacttccgggtcgggttcctaacccggttcctcccgtccgaccgtccccttacccgaacccgtaaacgggggaccccctaaggttccccgggttccccttttacccccccgtgggtaccccctaacccccttccccgttaccccaaaacgggtaccgtaccccg

SEQ ID NO: 200310 - DNA, 652 bp, Homo sapiens
  misc_feature: GYAE6OF01EVFUO.25.78.H01.1.454.CMB.1.raw
  modified_base (362)..(362): a, c, t, g, unknown or other
  misc_feature (362)..(362): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagttgtttcttactagttggggctggactccggccgggcccccgggaagggcctgggagtgggttgggcaggtgtaccaagtacggtacgaccctccccactaccgccccactccctcgacggggtccncctctacgttgtactaattcgacacctactaaagagcagttctctcgtcgggtctgtacttctcgtccaccgtctcggacacggccacactactattcgtgtcgtacggacacgtagtcgggaccgacgtacccttacccctttctacgtacggtcgggggaccgggtaagtccggtcggtcctacccgttcctccctcgacgtccctacccgaccgtaacggccctaacgttcccggtcccttcccccgacgggtaccctacccctaccctaccgaacgtacgtacccg

SEQ ID NO: 200311 - DNA, 214 bp, Homo sapiens
  misc_feature: GYAE6OF01DGAVO.25.78.H01.1.454.CMB.1.raw
  modified_base (212)..(214): a, c, t, g, unknown or other
  misc_feature (212)..(214): n is a, c, g, or t
tcagactgtacagtcacgaccggtgctcgatttagtgtgagtagtttgggtttgggtgcccaagctgctggagggcacggtcaccacgctgctgagggagtagagtcctgaggactgtaggacagccgggaaggtgggcacagcggccctgggctgcctggtcaaggactacttccactgtacagtctgagcgggctggcaaggcgcatagnnn

SEQ ID NO: 200312 - DNA, 217 bp, Homo sapiens
  misc_feature: GYAE6OF01DAT1G.25.78.H01.1.454.CMB.1.raw
  modified_base (212)..(217): a, c, t, g, unknown or other
  misc_feature (212)..(217): n is a, c, g, or t
tcagactgtacagtcacgaccggtgctcgatttagtgtgagtagtttgggtttgggtgcccaagctgctggagggcacggtcaccacgctgctgagggagtagagtcctgaggactgtaggacagccgggaaggtgggcacagcggccctgggctgcctggtcaaggactacttccactgtacagtctgagcgggctggcaaggcgcatagnnnnnn

SEQ ID NO: 200313 - DNA, 680 bp, Homo sapiens
  misc_feature: GYAE6OF01ETZVA.25.78.H01.1.454.CMB.1.raw
  modified_base (434)..(434): a, c, t, g, unknown or other
  misc_feature (434)..(434): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactagttgggctggatccggccggcccccgggaagggcctggagtggttgggcagtgtccaatacggtacgaccctccccactaccgccccactccctcgacggggtccgcctcacgttgtcaattgacacctctaaagaagcagttctctcgtggtctgtacttctgtcaccgccgcggacaccggccanactactattgtcgtcgtcggacacgagtcgggcccgaaccggtaccctttacccctttcgtaccgttaccgggtcggggggacccggggtaattccgggtcggttccctacccggttcccgttcccgtccgaccgtcccctacccgaacccggtaaaccggggtcccctaacggttccccggttccccttaccccccgtcgggtaccccctaccccgttacccctacccgaaacggccgtaccccg

SEQ ID NO: 200314 - DNA, 366 bp, Homo sapiens
  misc_feature: GYAE6OF01B0RR7.25.78.H01.1.454.CMB.1.raw
  modified_base (362)..(366): a, c, t, g, unknown or other
  misc_feature (362)..(366): n is a, c, g, or t
tcagactgtacagtcacgaccggtgctcgatttagtgtgagtagtttgggtttggggtagtcgtcgcctcacgttgtcaattgacacctctaagaagcagttctctctgggtctgacttctgtcaccgccgcggacacggccacatactattgtgtctcggacacatgggccgacgactacccctttctctactggggccggggaatcgtggtcaccgtctcctcagcctccaccaagggcccatcggtcttccccctggcaccctcctccaagagcacctctgggggcacagcggccctgggctgcctggtcaaggactacttccactgtacagtctgagcgggctggcaaggcgcatagnnnnn

SEQ ID NO: 200315 - DNA, 664 bp, Homo sapiens
  misc_feature: GYAE6OF01D2NXE.25.78.H01.1.454.CMB.1.raw
  modified_base (538)..(538): a, c, t, g, unknown or other
  misc_feature (538)..(538): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagttgtttcttactagttggggctggactccggccgggccccccggggaagggcctgggagtggttgggctagtgtaccgaaagttaccgggtacgacccctcccccaactaaccgccccgtaactccccgtcgacggggtccgccctcgtacgttgtacctaattcgacacctacgtaagaagctagttctctcgtgggtctgtacttctcgtccaccggtccgaccggtaccaccggaccactagttacttagttgtcgtcgtcggactagtcgtcgggacctaccgtacccttaccctttcncgtaacgtcgggggaccggtaatcggttacggtcctaccgtctccctcgacgcctacccgaccgaacggccctacgtcccggttcccttccccgcggccctaccccgtcctaccaagccgtacccg

SEQ ID NO: 200316 - DNA, 652 bp, Homo sapiens
  misc_feature: GYAE6OF01BNM56.25.78.H01.1.454.CMB.1.raw
  modified_base (350)..(350): a, c, t, g, unknown or other
  misc_feature (350)..(350): n is a, c, g, or t
  modified_base (515)..(515): a, c, t, g, unknown or other
  misc_feature (515)..(515): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattgggctggatccagcggcccccgggaaggcctggagtggttgggcagtgtcaagtacggtagaccctccccacttaccgccccactccctcgacggggtccncctcacgttgtcaattgacacctctaagaagctacgttctctcgtggtctgtactttctcgtcaccgtccgccggacaccgggccacgtattacccttagtttcgtacgtccgtcgggaaccacgtacgttcggggaccctacggtacccttaacccccgttttnccgttaaccggtcgggggacccgggtaattccgggttcggtcccgtacccgttctacccttcgacgtccctaccgaccgaacgggcccctagtcccggtcccttcccccgtggccctaccctcctaccgagtacccg

SEQ ID NO: 200317 - DNA, 662 bp, Homo sapiens
  misc_feature: GYAE6OF01E3G3R.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggcccctcggaaaccctgtccctcgcttgcactgtctctttcgactccatcagtagtgtttcttactattggggctggatccggccggccccccgggaaggcctggagtggttgggcagtgtccaatacggtagacctccccactacgccccatccctcgaggggtcgcctcacgttgtcaattgacacctctaaagacgcagttctctctgggtctgtacttctgtcaccgccgcgacacggccacatactattgtgtctcgacacagtgggcccgaacgacccttaccccgtttctacgttaccgttggggggacccgggtaattccgggttacggttacccacccggttccttaccctcgacggtcccctcccgaaacccgaaccgggtacccccaacggttcccgggtttccccttacccccccccggtgggaccccctaacccccttccccgttaccccgaaacggtccgtaccccg

SEQ ID NO: 200318 - DNA, 684 bp, Homo sapiens
  misc_feature: GYAE6OF01ADSWJ.25.78.H01.1.454.CMB.1.raw
  modified_base (152)..(152): a, c, t, g, unknown or other
  misc_feature (152)..(152): n is a, c, g, or t
tcagactgtacagtcacgaccggtgctcgatttagtgtgagtagtttgggtttgggggtccttctgagagtcatggacctcctgtggaagaacttgaggcacctgtggttctgcctcctactggtggcggctcccagatgggtcctgtcccngctgcaggagtcgggcccaggactggtgacggccctcggaaaccctgtccctcgcttgcactgtctctttcgactcatcagtgttgtttcttactagttgggctggacgtccggccggacccccggggaggcctggagtggttgggcagtgtaccaagtaccgggtacgacccctcccacctaccgccccacgtcccctacggacggggttccgccctccgtacgttcgtactaacttcgacctacctcgtaaacgaagctagttcctcgtcgtggtctcgtacttcgtcgtcacccggcgacggaccacgaccactatacttattcgtcgtcgtcggaactacgtacgtcgggaccgtacccgtacccttaccccttttcgtaccgttacgggtaccgggggtccgggtaagttccggtagtccccgtacgtcctaccctcgacctcccgtaccaccggtacgggtcccacggttcccggtcccttaccccgcgtacccgacccctacccgtaccgaaccgtgtaccccgg

SEQ ID NO: 200319 - DNA, 212 bp, Homo sapiens
  misc_feature: GYAE6OF01CFC3S.25.78.H01.1.454.CMB.1.raw
  modified_base (211)..(212): a, c, t, g, unknown or other
  misc_feature (211)..(212): n is a, c, g, or t
tcagactgtacagtcacgaccggtgctcgatttagtgtgagtagtttgggtttgggtgcccaagctgctggagggcacggtcaccacgctgctgagggagtagagtcctgaggactgtaggacagccgggaaggtgggcacagcggccctgggctgcctggtcaaggactacttccactgtacagtctgagcggctggcaaggcgcatagnn

SEQ ID NO: 200320 - DNA, 613 bp, Homo sapiens
  misc_feature: GYAE6OF01AOWZR.25.78.H01.1.454.CMB.1.raw
  modified_base (410)..(410): a, c, t, g, unknown or other
  misc_feature (410)..(410): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattgggctggatccggcggccccccgggaagggcctggagtggttgggcagtgtccaatacggtagacctccccactaccgccccatccctcgacggggtccgcctcacgttgtctaattgacacctctaagagcagttctctctgggtctgtacttctcgtcnccgccgcggacacggccacatactattgtcgtctcggacacgagtcggccacgtcctaccctttctcgtacgtcgggggccggtaatcggtcgtccaccgttctccctcgacgccctaccgaccgaacgggccccaacgtcccgggttcccttccccccgtggtacccctacccccgtccctaccgaaacggtccgtaccccg

SEQ ID NO: 200321 - DNA, 664 bp, Homo sapiens
  misc_feature: GYAE6OF01BKVZ6.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagttgtttcttactagttgggctggagtccggccggcccccgggaagggcctggagtggttgggcagtgtccaagtacggtacgacctccccactacgccccatcccgtcgacgggtcgcctcacgttgtctaattcgacacctactaacgaagtcagttctcttcgtgggtctgacttcgtcgtcaccgccgcggacacggccacatactattgtcgtccgtacggactacgtacggtcggacccgacgtaccttacccctttctcgtacggtcgggggtacccgggtaagttccggttacggtcctacccggtccttcccgtcgaccgtcccgtacccaacccggacgggcccctacggttccccggttccctttccccccggtcggtcccctaccccgttaccctacccgaaacggtccggtaccccg

SEQ ID NO: 200322 - DNA, 645 bp, Homo sapiens
  misc_feature: GYAE6OF01DINJ4.25.78.H01.1.454.CMB.1.raw
  modified_base (420)..(420): a, c, t, g, unknown or other
  misc_feature (420)..(420): n is a, c, g, or t
  modified_base (441)..(441): a, c, t, g, unknown or other
  misc_feature (441)..(441): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctcttcgactccatcagtagtgtttctactagttgggctggactccggccggccccgggaaggcctggagtggttgggcagtcgtacaagtacggtacgaccctcccgactaccgccccattcccgtcgacggggtccgcctctaacgttcgtacaattcgacctaactacgaaagaagctaagttctctcgtggtctgacttcgngtcaccgcgcgacacgccaanactactattgcgtcacgacacgagtcggacccgtaacgtaccttaccctttcgaccgttacgtcggggggtaccggtaagttccggtacggttacccacccggtttcctccgtacgacgtccccttaaccgaaccggtacgggcccctaacggttcggttacccttccccgagtccctaccccttccgaccaaggtcgtacccg

SEQ ID NO: 200323 - DNA, 805 bp, Homo sapiens
  misc_feature: GYAE6OF01BXQRP.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctccagatgggtcctgtcccagctgcaggagtcgggcccaggactggtgaggccctcggaaaccctgtccctcgcttgcactgtctcttcgactcatcagtagttgtttcttacttagttgggctgggacgtccggggtccgggcccccggggaagggccgtagggtaggttgggtttggggctaggtcgtaccaaagttaccggtaacggtaccctaccccgaaccttacccgccccctaacgtccccgtcggacggggtccgccttacgtacgttagttctaaagttcgaacctacctaacgtaaagaacgtctaacggtttctacgttcggttacgggttcttagtacctttcgttcgtccgacccgtccggacgaaccgtaccggccaacgtatacgttagttcgtcgtaccgtacggactaacgtacggtaccgggacccctacggtaaccctttacccccgttttcaccggttaaccggttccgggggggtaccgggtaactttccggggtaccggtacccttacccgggtcctcccgtacgtacccggaccccgttacccgaaaccccggtaacgggcccctaacggttcccccgggttacccctttccccccgtacggtaccccctaccccgttaccccgtaccggaaaacgtccccggtaaaccccg

SEQ ID NO: 200324 - DNA, 778 bp, Homo sapiens
  misc_feature: GYAE6OF01BLALQ.25.78.H01.1.454.CMB.1.raw
  modified_base (367)..(367): a, c, t, g, unknown or other
  misc_feature (367)..(367): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctacggaaccctgtccctgcttgcactgtctctttcgactcatcagtagttgtttcttactagttggggctggactccgggccggcccccggggaaggccgtgggaggttgggttgggctagtcgtaccgaaagttacggtacgaccctccccactaccggccccatcccgtcgaggggtccncctactacgttcgtactaattgaacctacctctaaagaacgtctagttctcgtacgtggtactgtacttctcgtccgtaccgccggtacggacgaccggacctaacgtaacttacgttagttgtcgttacgtaccgggaacctacgtacgtcggggacccttaacccggttaccctttacccccgttttagtacccggttaaccgggtccggggggggtacccggtaaagtttccccggggtaggttcccctaacccgggttcccgtacccttaccggaacccgttccctacccggtaacccggtaaaccggggtccccctaaacggtttccccgggttacccccgttacccccccgtcgggtaccccctaaccccccggtttaccctacccgaaaggtccccgtaacccg

SEQ ID NO: 200325 - DNA, 797 bp, Homo sapiens
  misc_feature: GYAE6OF01AK61A.25.78.H01.1.454.CMB.1.raw
  modified_base (604)..(604): a, c, t, g, unknown or other
  misc_feature (604)..(604): n is a, c, g, or t
  modified_base (763)..(763): a, c, t, g, unknown or other
  misc_feature (763)..(763): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagagtgggtcctgtcccagctgcaggacgtcgggcccaggactggtgacggccctacggaaccctcgtccctcgtcttgctactgtctcgtggtcggcctaccatccgaggtactaactcgactacgtacgtcgggcctggactcccggaccaccggacccccggaaggggaacgggccgtgggaggtcggtagttcggctacgtacgatatcgaagttacggacgggtacaacctttccgaacccgtaccccgtacctacgaaggtacgtcgaacgtccaccgtaatacgtactaagttcgaactaccgtaccaaaggtcgtacctaacggttccgtaccgtaggaacgtcgtaggtacgtccttcggtacgtacggtaaccccggccggtaaccgggtaccgtaacccgggtccgtttagttaaccgtttcggttacgttacggaaggtaacgtaacggtaaacggtntaccgtaggtaacggacggttcggtaaccttaaccggtacgggtttaaccccggggttccgggggtttaagtacccggttaacgggggtccggggtaccgtaccggggggtaccctttcccggtaccgggtaccccgttccggtttacccggtacccgngttacccccggtaccctaacccgggtaccccggg

SEQ ID NO: 200326 - DNA, 793 bp, Homo sapiens
  misc_feature: GYAE6OF01BDM90.25.78.H01.1.454.CMB.1.raw
  modified_base (384)..(384): a, c, t, g, unknown or other
  misc_feature (384)..(384): n is a, c, g, or t
  modified_base (748)..(748): a, c, t, g, unknown or other
  misc_feature (748)..(748): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggccaggactggtgaggccctcggaaaccctgtccctcgcttgcactgtctctttcgactccatcagtagttgtttcttactagttggggctggacgtccggccgggcccccgggaagggcccgtagggaggtgggttcggggctaggttacgtaccaagttaacggtacgacccctaccccacgtaccggaccccacttccccgtcgtacgggggtccncccgtaccgtacgtttgtacctaaacgtttcggacctacctcgtaaacgtaagctaacgttctccgttacgtcgggtctacgtacttccgtcgtccgaccgtccgggcggacctaccggaccactaacgtacttagttcgtcgttaccgacggtaccaacgtacgtaccggggtacccgtaaccgtaaccctttacccccggttttcacccggttaccgggttaccgggggggacccgggttaacggttcccgggttacggttacccgtaacccgtttccgtccccgttacgtaccggcccttaacccggaacccggtaacggggtaccccctaacgttccccgggttccccgttaaccccccncgggtacccctacccccggttctaacccgcggtaccgtaaccccg

SEQ ID NO: 200327 - DNA, 385 bp, Homo sapiens
  misc_feature: GYAE6OF01CDWUM.25.78.H01.1.454.CMB.1.raw
  modified_base (262)..(262): a, c, t, g, unknown or other
  misc_feature (262)..(262): n is a, c, g, or t
  modified_base (366)..(366): a, c, t, g, unknown or other
  misc_feature (366)..(366): n is a, c, g, or t
  modified_base (372)..(385): a, c, t, g, unknown or other
  misc_feature (372)..(385): n is a, c, g, or t
tcagactgtacagtcacgaccggtgctcgatttagtgtgagtagtttgggtttggggtagtcgtcgcctcacgttgtcaattgacacctctaagaagcagttctctctgggtctgacttctgtcaccgccgcggacacggccacatactattgtgtctcggacacatgggccacgactacccctttctctacgtggggccgggaatcgtggtcaccgtctcctcacgcctccaaccaaagggcccatccggtccttcccccnggccaccctcctaccaagagcacctcgtggggacacgagcggccctgggctgccgtggtcaaaggctacttccactgtacagtctgacgcgggctggcaaggcncatagnnnnnnnnnnnnnn

SEQ ID NO: 200328 - DNA, 635 bp, Homo sapiens
  misc_feature: GYAE6OF01EDAUO.25.78.H01.1.454.CMB.1.raw
  modified_base (345)..(345): a, c, t, g, unknown or other
  misc_feature (345)..(345): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctcttcgactccatcagtagtgtttcttactattgggctggatccggcggcccccgggaaggcctggagtggttgggcagtgtaccaatacggtagacctcccactaccgcccatccctcgacggggtccncctcacgttgtactaattgacctacctctaagaacgctagttcctctcgtgggtctgtaccttctgtccaccgccgtacggacgacggacccacacttacttattcgtgtctacggacacgtagtcgggaccgacgtaccttacccctttctccgttaccgtacggggccgggtaatccggtaggtccaccgttcctccgtccacgtccctaccgaacccgtacgggcccctacgtcccggttcccttcccccgtcggtcccctacccctcctaccctaacgcgtacccg

SEQ ID NO: 200329 - DNA, 383 bp, Homo sapiens
  misc_feature: GYAE6OF01AREDV.25.78.H01.1.454.CMB.1.raw
  modified_base (277)..(277): a, c, t, g, unknown or other
  misc_feature (277)..(277): n is a, c, g, or t
  modified_base (356)..(356): a, c, t, g, unknown or other
  misc_feature (356)..(356): n is a, c, g, or t
  modified_base (361)..(383): a, c, t, g, unknown or other
  misc_feature (361)..(383): n is a, c, g, or t
tcagactgtacagtcacgaccggtgctcgatttagtgtgagtagtttgggtttggggtagtcgtcgcctcacgttgtcaattgacacctctaagaagcagttctctctgggtctgacttctgtcaccgccgcggacacggccacatactattgtgtctcggacacatgggccgacgactacccctttctctactggggccggggaatcgtggtcaccgtctcctcagcctccaccaagggccccatccggtcttccccctggccaccctcctcaagngcacctctgggggcacagcggccctgggctgcctggtcaaggctactccatgtacagtctgagcgggctggcaaggcgnatagnnnnnnnnnnnnnnnnnnnnnnn

SEQ ID NO: 200330 - DNA, 867 bp, Homo sapiens
  misc_feature: GYAE6OF01EU2YC.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagagtgggtcctgtcccagctgcaggaggtccgggcccaggactgggtgacggccctacggaaaccctgtccctcgcttgcactgtctcttcgactcatcagtagtgtttactactagttcgggctggacgtcccggccgggaccccgggaggccgtggtaggtgggttggctacggtcgtaccgtaaagtacggtaccgaccccttaccccgactaccggcccctaacgtccccgtcggtaccggggtccctccgtaccgtacggtttcggtactaacgtttacgacctacccgttacgtaaacgaacgtactacgttccgttcgtacgttcggggttcctacggtttacctttccggtaaccgttcccggacccggtacccggaccggtaaccgtaccggttaccaacgtaactttacgttaggtttacgtcgttaccgtacggaaccacggtaggtccgggaccctaacccggttacccctttaccccgtttcgaccggttacggggtacccggggggtaccggtaacgttaccgggttccggttaccgtacccgtttcccgttacccgtacgtccccggttaacccccgtacccgtaaacccggggtaccccggttacccttaacccggggtttcccccgttccccccgtttaaacccccggcccggttaaccccccttacccccggttaaccccgtaaccggtaacccggtaacctacccccccgggg

SEQ ID NO: 200331 - DNA, 981 bp, Homo sapiens
  misc_feature: GYAE6OF01CJOV5.25.78.H01.1.454.CMB.1.raw
tcagactgtacagtcacgaccggtgctcgatttagtgtgagtagtttgggtttgggggccttctgagagtcatggacctcctgtaggaagaacttgaggcacctgtggttctcgcctcctactggtcggcggcctcccagagtcgggtcctcgtcccagctgcgagggacggtccgggacccgaaggtacgtggtcgacggcccgtaccggaaaccctccgtccctcgtcgttcgctactcgttcttccttaccgacctcctatcgtagttacgtttcgttttacttaacgttaggttgggacgtcggaccggtcccggggaccccggggtaccccggggaacgggtccgtggggtacgggttgggtcggacgttacggtcgtaaccgtaaacggtaccggtaaccgtacccctaccccgaaccgtaaccccgtaccccgtacctccccgttaccggaccgggtcccgtcctccgtacgttacgtactaacgttaccgaacctaaccgttaacgtaaacgaacgtaccttacgttcccgttacgttcggtcggttacgtacgttaccgttccgtaccggtacccgaccccgggtacccggacccggtaaccggaccccgtaacccgtaaccgtttaacgttaaccgttacggtttacgtcccggtaaccggtaaccggaaccgtaaccgggtacggtaccccgggttaacccccgtaacctttaaacccccgttttcccccgtttaacggtcccgggttaaaccgggggttcccggggggtaaaccgttcggttccggttcccggttaaaccccgcccgtttccgtaccctaacccgtacccgtacccccgttacccggaaacccgggtacccgggtaccccgtttcccgggttcccccgtttaccccccggttccccgtaaccgggtaacccccctttacccgtaccccccgaaaggaaccccggtccccggtaacccgg

SEQ ID NO: 200332 - DNA, 758 bp, Homo sapiens
  misc_feature: GYAE6OF01DKLSJ.25.78.H01.1.454.CMB.1.raw
  modified_base (369)..(369): a, c, t, g, unknown or other
  misc_feature (369)..(369): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctcgtccctcgcttgcactgtctcttcgactccatcagtagtgtttcttactagttgggctggacgtccgggcccgggcccccggggaagggcccgtgggaggtgggttgggcagtgtaccaagtacggtacgaccccgtccccacgtaccgcccactcccgtcgacggggtccnccgtctacgtttcgtactaatcgacctacctactaagaacgtctagttcctctcgtcgggtctgtcttcgtcgtccgaccggccgtcggacccgaccggcccaacgtattaacgttagtttgtcgtccgtacggtaaccacgtacggtccggggacccgtaacccgttaacccctttaacccccgttttcgtaccggttaacccgggtcgggggggaacccgggtaattccgggtacggttaccctaacccgggttcctacccgtacccgtaccggcccctaacccgaaccccggaaaccggggtcccctccggtttaccccgggttcccctttcccccccgtgggtcccccctaccccgttcccgtaacccgaacggtccgtaccccg

SEQ ID NO: 200333 - DNA, 917 bp, Homo sapiens
  misc_feature: GYAE6OF01EO914.25.78.H01.1.454.CMB.1.raw
tcagactgtacagtcacgaccggtgctcgatttagtgtgagtagtttgggtttgggggccttctgagagtcatggacctctgtggaagaacttgaggcactgtggttctgcctctacgtggtggcgctccagagtgggtcctgtcccagctgcaggcgtccgggccaggtactggtgacggccctacggaaccctgtccctgcttgcactgtctctttcgactcatcagttagttcgttttctaacgtagttgggctggaccgtcccggggccgggtacccccgggaggtccgtgggacgggttgggtcggacgtagtcgtaaccgtaaaggtaccggtaaccgtaaccctccccgaacgttaccgaccccctaagttccccgtaggtccggggttcctacccgttacgtacgtttcggtaacttaaacgttaccgaaccttaacccgttaacgtaaacggaacgtcttaacgttccgttacgtcggtaggtacttcgtacttcgtacgtcccgtacggacccgggtacggtaaccgtaacccggtactaaaccgttacgttaacgttacgtttacgggttaccgtccggttaaccggtaaccgtaccggttacgggttaccgggtaaccccgtacccgttaaccccgtttttacccccgtttacggttacccggttaaacccgggggttacgggggaaccccggggttttagttaccccggggttacggttaccccgttacccggtttaaccccgggttcctaacccggttaccccggtaaccccgttaacccccggtaaaccggggtaccccggtacccttaccccgggttcccccgttaccccgttttccccccgggacgtaaccccccgttccccttaacccggttaacccgaaacggttccccgtaacccgg

SEQ ID NO: 200334 - DNA, 704 bp, Homo sapiens
  misc_feature: GYAE6OF01CDR2H.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgacggccctcggaaaccctgtccctcgcttgcactgtctctttcgactccatcagtagttgtttcttactagttggggctggacgtccggggccgggccccccggggaagggcccgtgggaggttgggttgggctaggtcgtaccgaagttaccgggtacgacccctccccaccgtaccgccccacttcccctcggacggggtccgccctacgtacgtttcgtactaacgttcgacctacctacgtaaacgaacgctacgttctcgtcgtgggtctcgtacttctcgtccaccggccgacggacgaccggacccactactacttagttgtcgtacgtacggacacgtacgtcgggaccctacgtaccttaccctttactcgttacggtacgggggccgggtaagtccggtacggttcctaccggtcctcctcgaccgccctacccgaccggaccggtccctacggttcccggtacccttcccccgtcggtaccccaccccttacccgaccgaaacgtccgtacccg

SEQ ID NO: 200335 - DNA, 774 bp, Homo sapiens
  misc_feature: GYAE6OF01AB1R1.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcgctccagatgggtcctgtcccagctgcaggagtccgggcccaggtacgtggtacggacggtcccgtaccgggtaaaccctcgtccctcgtcttcgctactcgtcttctttcgacctccatcgtagttagttgtttacttacgtaggttcgggctgggacgtccgggcccgggaccccggggaggccgtggaggttcggtggctagtcgtactaagtccggtacgtaccctcccgaactcccgaccccacttcccgtggaccggggtcctccgttcgtacggttcgtactaacgttcgaacctaccgttaacgtaaacgacgtacttacggttacctcgtcggtcggttactacgttaccgtttcgtacggtaccgacccgtacgggaccgtcgaccggacctaacgtactttacgttgttacggtcgtccgaaccgtacacggtcggtaaccgggtaccctaacccgttacccttacccgtttgtaaccgggtccggggtacgggacggttactcggtttccgcccgttaccgtcctactcccgacgtccccgtacgaacccggtccgggtacccttccggttcccgttaccccgttccccggactacccccggtacccttacgtaccgaacgttcctaaccccggg

SEQ ID NO: 200336 - DNA, 724 bp, Homo sapiens
  misc_feature: GYAE6OF01AG0GI.25.78.H01.1.454.CMB.1.raw
  modified_base (354)..(354): a, c, t, g, unknown or other
  misc_feature (354)..(354): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctgcttgcactgtctctttcgactccatcagtagtgtttctactgttgggctggactccgggccggcccccgggaggcctggagtggtgggcaggtcgtaccaagtacggtacgacccttccccgactaccgccccatcccctcgaggggtccncctcgtacgttgtactaagttcgacctaccgttctaaacggtaacgtccgtacgtttcctcttcgttcggggtaccttacggtacctttcgttcggtccacccggcccggtaccgggacaccgggccctaacacttaccttagttcgtcgttccgtaccggactaaccgtggtcccgggacctaaccgtaccctttacccctttctaccgttacgggtccggggggtaccggtagttccgggttacggtccctaacccgttcctaccgtacgaccgtccctacccggaacccggtaacggccccttacgttcccggttaccccttccccgtggaccccctccccttacccgtcaaacggtccctacccgg

SEQ ID NO: 200337 - DNA, 662 bp, Homo sapiens
  misc_feature: GYAE6OF01D4YMY.25.78.H01.1.454.CMB.1.raw
  modified_base (359)..(359): a, c, t, g, unknown or other
  misc_feature (359)..(359): n is a, c, g, or t
  modified_base (427)..(427): a, c, t, g, unknown or other
  misc_feature (427)..(427): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctccagatgggtcctgtccagctgcaggagtcgggcccaggactggtgaggccctacggaaccctgtcctcgcttgcactgtctcttcgactcatcagtagtgtttcttactagttggggctggatccaggccggcccccggggaagggcctgggtaggtcgggttgggactaggtgtaccaagtacggtacgaccctcccgactaccgcccactcccgtcgacgggtcnccgtctacgttcgtactaacttgaccactactaaagaacgctagttctcgtcgtggtctgtactttcncgtaccaccgccgcgaaccgacggaccatactattacttggtctctacgacacgtaacgtcgggacctacgtaccttacccctttacgtcggttaacggtcgggggtacccggggtaattccgggtacgtccgtacccggtccttccgtcgtaccgcccgttacccaaccggtaccggacccttacggtcccgtcccttccccgtcgacccctacccgtccctaacgacgtaccg

SEQ ID NO: 200338 - DNA, 810 bp, Homo sapiens
  misc_feature: GYAE6OF01BVPWU.25.78.H01.1.454.CMB.1.raw
tcagactgtacagtcacgaccggtgctcgatttagtgtgagtagtttgggtttgggggcctttctgagagtcatggacctcctgtggaagaacttgaggcacctgtggttctgcctcctactggtggcggctcccagagtgggtcctgtcccagctgcaggagtcgggcccaggacgtggtgacggccctcggaaaccctcgtccctcgtcgttgctactgtcttcttcgactccatcgagttacgtcgttttcttacgtagttcgggcgtcggtacgtccgggcccggggacccccggggaaggtccgtgggtacggttgggtcgggactacggtcgtaccgaaagttacggtacgaccccgttccccgaactacccggcccctactccccgtacggtaccgggtccgtccgtacgtacggtttcgtacgttaacgttcgaaccctaccttacgtaaacggtaacgtcctacggtttctccgttacggtcggttaccgttcgttactttccgttcgtcccggtacccgccgggaccggaacgaccccggcaaaccttacgtaacttagtttcgacgttccgtacggaacctacggtacggtaccgggtcccgaacccgtttaacccgtttcccgttttacgaccgggtttacgggtccgggggggaacccgtttaaggttccggttaccgggttccacccgggttcctccgtaccgaccgttccccgacccgaaccgggcgtaccccgtcggttccccggttccctttccccgacggttcccacccgttacccaagcccgcgtacccgg

SEQ ID NO: 200339 - DNA, 874 bp, Homo sapiens
  misc_feature: GYAE6OF01CF4UQ.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatggtcctgtcccagctgcgaggacgtcgggcccaggacgtgggtgacggcccgtacggtaaaccctcgtcccgtcgtcttcgctactgtcttcgttcgactccatctaggttagttgttttacttacgttaggttgggtcgtggacgtcccggggcccgggacccccggggaaggtccgtaggtaggttcgggttcgggcgtaacggtctaacgtaaacgttaccggttaccgacccctaccccgtaccgtaccccgtacccctacgttccccggtacggtaccggggtcctccgtacgtacgtttacgtacgtaacgttcgaacctaccgttaacgtaaagaacgtacttacgttacttcgttcggttacggttccttacgtaccgtttcgtacgtaccccgtacccgggcccggaccggtaacccgaccgtaaccctaacttacgttacgttaacgtttcggtaccgtaccgtaaccgtacgaaaccgtcggtaccgggaccctaacccgtttacccttaccccgttttcgacccgggttcgggtacgggggtacccggttacgttccgggttacaccccgtttccgtaccgtccgtaccgtacccgacccgttacccgaaacccgggttcccgggtacccttacccggtttccccgggttccccccgttaaacccccggttccgaccccctttaaccccggtaccccgtaaccgtaaggcccccggtaacccgg

SEQ ID NO: 200340 - DNA, 366 bp, Homo sapiens
  misc_feature: GYAE6OF02HX8ZK.25.78.H01.1.454.CMB.1.raw
  modified_base (361)..(366): a, c, t, g, unknown or other
  misc_feature (361)..(366): n is a, c, g, or t
tcagactgtacagtcacgaccggtgctcgatttagtgtgagtagtttgggtttggggtagtcgtcgcctcacgttgtcaattgacacctctaagaagcagttctctctgggtctgacttctgtcaccgccgcggacacggccacatactattgtgtctcggacacatgggccgacgactacccctttctctactggggccgggaatcgtggtcaccgtctcctcagcctccaccaagggcccatcggtcttccccctggcaccctcctccaagagcacctctgggggcacagcggccctgggctgcctggtcaaggactacttccactgtacagtctgagcgggctggcaaggcgcatagnnnnnn

SEQ ID NO: 200341 - DNA, 364 bp, Homo sapiens
  misc_feature: GYAE6OF02FTQIS.25.78.H01.1.454.CMB.1.raw
  modified_base (362)..(364): a, c, t, g, unknown or other
  misc_feature (362)..(364): n is a, c, g, or t
tcagactgtacagtcacgaccggtgctcgatttagtgtgagtagtttgggtttggggtagtcgtcgcctcacgttgtcaattgacacctctaagaagcagttctctctgggtctgacttctgtcaccgccgcggacacggccacatactattgtgtctcggacacatgggccgacgactacccctttctctactggggccggggaatcgtggtcaccgtctcctcagcctccaccaagggcccatcggtcttccccctggcaccctcctccaagagcacctctgggggcacagcggccctgggctgcctggtcaaggactacttccactgtacagtctgagcgggctggcaaggcgcatagnnn

SEQ ID NO: 200342 - DNA, 367 bp, Homo sapiens
  misc_feature: GYAE6OF02H3LCG.25.78.H01.1.454.CMB.1.raw
  modified_base (363)..(367): a, c, t, g, unknown or other
  misc_feature (363)..(367): n is a, c, g, or t
tcagactgtacagtcacgaccggtgctcgatttagtgtgagtagtttgggtttggggtagtcgtcgcctcacgttgtcaattgacacctctaagaagcagttctctctgggtctgacttctgtcaccgccgcggacacggccacatactattgtgtctcggacacatgggccgacgactacccctttctctactggggccggggaatcgtggtcaccgtctcctcagcctccaccaagggcccatcggtcttccccctggccaccctcctccaagagcacctctgggggcacagcggccctgggctgcctggtcaaggactacttccactgtacagtctgagcgggctggcaaggcgcatagnnnnn

SEQ ID NO: 200343 - DNA, 589 bp, Homo sapiens
  misc_feature: GYAE6OF02F2XZK.25.78.H01.1.454.CMB.1.raw
  modified_base (417)..(417): a, c, t, g, unknown or other
  misc_feature (417)..(417): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattgggctggatccggcggcccccgggaaggcctggagtggttgggcagtgtccaatacggtagacctccccactaccgccccatcccctcacggggtcgcctcacgtttgtcaattgacacctctaagaagcagttctctctgggtctgacttctgtcaccgcgcggacncggccacatactattgtgtctcggacacatcgggccgacgaccttacccctttctctaccgtggggaccgggaatcgtcggtcaccgtctcctcacgcctccaccgaacgggcccagtcccggttcccttcccccgtgggccctaccccgtccctacccaacgacgtacccg

SEQ ID NO: 200344 - DNA, 643 bp, Homo sapiens
  misc_feature: GYAE6OF02G6T93.25.78.H01.1.454.CMB.1.raw
  modified_base (352)..(352): a, c, t, g, unknown or other
  misc_feature (352)..(352): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattggggctggatccgggcggcccccgggaagggcctggagtggttgggcagtgtccaatacggtagaccctccccactaccgccccatcccctcgacggggtccncctcgacgttcgtcaattgaccacctctaaagaagcagttctctcgtggtctgtacttctgtcaccgcgcgacacgccacactactattgtgtctcggacacagtcgggccgacgtaccttacccctttctccgttaccggtcgggggaccgggtaagttccggtacggtccgtacccgtctccctcgaccgcccttacccgaacccggtaacgggcccctaagttccccggttcccgttccccccgtcggtacccctacccccgttaccctacccgaaccggactccccg

SEQ ID NO: 200345 - DNA, 577 bp, Homo sapiens
  misc_feature: GYAE6OF02IK8D3.25.78.H01.1.454.CMB.1.raw
  modified_base (552)..(552): a, c, t, g, unknown or other
  misc_feature (552)..(552): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattggggctggatccggcggcccccgggaagggcctggagtggttgggcagtgtccaatacggtagacctcccactacgccccatccctcagggtccgcctcacgttgtcaattgacacctctaacgaagcagttctctcgtggtctgacttctgtccaccgccgcggacacggccacatactattgtgtctcggacacagtcgggccgacgacttacccctttctctacgtcggggaccgggtaatcgtagtccaccgtctccgtcacgcctaccaccgaacggcccagtccggtccttccccgnggccacccctcctaccacgctaccg

SEQ ID NO: 200346 - DNA, 638 bp, Homo sapiens
  misc_feature: GYAE6OF02IHA4G.25.78.H01.1.454.CMB.1.raw
  modified_base (346)..(346): a, c, t, g, unknown or other
  misc_feature (346)..(346): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattggggctggatccggcggccccgggaagggcctggagtgggttgggcagtgtccaatacggtagacctcccactaccgccccatcccctcaggggtcncctcacgttgtcaattgacacctctaagaagcagttctctctggtctgacttctgtcaccgcgcgacncggccacatactnttgtntctcggancagtcggccgactacctacccctttctcgtacgtcgggggaccgggaatcggtcggtccaccggtcctcccgttcacgtccccttacccgaaccgtaaccggggtacccccaacgttccccgggttaccctttccccccccggttaggggtacccctaccccccgttacccgttacccgaaccggaccggtacccccg

SEQ ID NO: 200347 - DNA, 592 bp, Homo sapiens
  misc_feature: GYAE6OF02GXK6R.25.78.H01.1.454.CMB.1.raw
  modified_base (347)..(347): a, c, t, g, unknown or other
  misc_feature (347)..(347): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttctactattggggctggatccggcggcccccgggaagggcctggagtggttgggcagtgtccaatacggtagaccctcccactaccgccccatcccctcgaggggtcncctcacgttgtcaattgacacctctaagaagcagttctctcgtgggtctgtacttctgtccaccgccgcggacacggccacatactattgtgtctcggacacagtcgggccacgacctacccctttctctacgtgggggccgggaatcggtggtccaccgtctcctcagccctccaccgaacgggccctaagtccggttcccttcccccgtcgggacccaccccgttccctaccgaacgacgccc

SEQ ID NO: 200348 - DNA, 810 bp, Homo sapiens
  misc_feature: GYAE6OF02G6T60.25.78.H01.1.454.CMB.1.raw
  modified_base (346)..(346): a, c, t, g, unknown or other
  misc_feature (346)..(346): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctcttcgactccatcagtagtgtttcttactattgggctggatccggcggccccgggaaggccgtggagtggttgggcagtgtccaagtacggtagacctcccactaccgccccatcccctcgacgggtccncctcacgttgtactaagttcgaccacctactaaagaacgtctagttctcgttccggtctgtacttcgtcgtccgaccgcccggtacggaaccgtaccggacccaacgtaactttaaccgttaacgtttcggttaccggttacccgttaccggggaaaccctaccgtaaacggttccgggggaccccgtaaacccggtaaccccgtttaaccccccgtttttaccgtacccgttaaccgggttaccgggggggttaacccggggtaaacggtttcccgggttacggttacccgtaacccgttcccttcccgttaccgtaccgtccccttacccgaacccggtaaaccggggtcccccgttaacgtttccccggggttaccccctttcccccccggttacgggtacccccttaccccccgttacccgttaaccccggaaacggtacccggtacccttaaccccggg

SEQ ID NO: 200349 - DNA, 595 bp, Homo sapiens
  misc_feature: GYAE6OF02I6IZ4.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattggggctggatccggcggcccccgggaaggcctggagtggttgggcagtgtccaagtacggtagaccctcccactaccgccccatccctcaggggtcgcctcacgttgtcaattgacacctctaagaagcagttctctctggtctgacttctgtcaccgccgcggacaccggccacactactattgtcgtctcggacactagtcgggacccgacgtaccttcccctttctccgtacgtcgggggaccgggtaatcggtcggttaccgtcctcctcagccctaccgacacgggccctagtccggtcccttacccgtggcccaccctccctccgaacgcgcctacccgg

SEQ ID NO: 200350 - DNA, 624 bp, Homo sapiens
  misc_feature: GYAE6OF02F0AJX.25.78.H01.1.454.CMB.1.raw
  modified_base (380)..(380): a, c, t, g, unknown or other
  misc_feature (380)..(380): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattggggctggatccggcggccccgggaagggcctggagtggttgggcagtgtccaatacggtagacctccccactaccgccccatcccctcgaggggtccgcctcgacgttgtcaattgacacctctaagaancagttctctctgggtctgtacttctgtcaccgccgcggacacggccacatactattgtgtctcggacacagtcggccgacgaccttacccctttctcgttacgtcgggggccgggtaatcggttggtcctacccgttctacccgtcgacgtccctaccgacccgaacgggcccctacgtcccggttaccctttcccccgtacggacccctaccccgttaccccgacccgtaacgccgtaccccg

SEQ ID NO: 200351 - DNA, 647 bp, Homo sapiens
  misc_feature: GYAE6OF02I6DIM.25.78.H01.1.454.CMB.1.raw
  modified_base (358)..(358): a, c, t, g, unknown or other
  misc_feature (358)..(358): n is a, c, g, or t
  modified_base (384)..(384): a, c, t, g, unknown or other
  misc_feature (384)..(384): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactattggggctggactccggccggcccccgggaagggcctgggaggtgggttggcagtcgtccaagtacggtagaccctccccactaccgcccctactcccgtcgacggggtcnccctcacgttgtacaattgacacctnaaacgagctagttctctctggtctgacttctgtccaccgtccgcggaccaccggtccaactatactagttgtcgtctacggacacagtcgggaccacgtaccttacccctttgacgtacgtggggacccggtaattccgggtagtccgaccgttctcccgtagaccgtccctaccgaaccggaacgggcccctaaggttcccggttaccccttttcccccgacggtcccctacccccgttccgaccaaccggtcgtacccccg

SEQ ID NO: 200352 - DNA, 607 bp, Homo sapiens
  misc_feature: GYAE6OF02GK3IY.25.78.H01.1.454.CMB.1.raw
  modified_base (443)..(443): a, c, t, g, unknown or other
  misc_feature (443)..(443): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggtggctcccagatgggtcctgtcccagctgcaggagtcgggcccaggactggtgaggccctcggaaaccctgtccctcgcttgcactgtctctttcgactccatcagtagtgtttcttactagttggggctggatccggcggcccccgggaaggcctggagtggttgggcagtgtaccaagtacggtagaccctccccactaccgccccactccctcgacggggtccgcctcacgttgtcaattgacacctctaagaagctagttctctcgtggtctgtacttctgtcaccgccgcgacacggccacatactattgtntctcggacacgagtcgggaccacgtaccttacccctttctccgttaccggtcgggggaccgggtaattccggtcgtcctaccgtctcctcacgccctccaaccgaacgggccctacgtccgttacccttccccgcggccctaccccgtcctaccacgtcgaccc

SEQ ID NO: 200353 - DNA, 709 bp, Homo sapiens
  misc_feature: GYAE6OF02H8QMJ.25.78.H01.1.454.CMB.1.raw
  modified_base (213)..(213): a, c, t, g, unknown or other
  misc_feature (213)..(213): n is a, c, g, or t
  modified_base (377)..(377): a, c, t, g, unknown or other
  misc_feature (377)..(377): n is a, c, g, or t
tcagactgtacagtcacgaccggtgctcgatttagtgtgagtagtttgggtttgggggaggcctggtcaagcctggggggtcccgaagactctcttgtgcagcctctggattcaacttcaaaggctacagcatgaactggatccgccaggctccggggaaggtctgcagtggatttcatccgattagtggtcttaagcgtgacaaatttttangcagactcggtgaacggccggttacaccatctaccagacgacaacgccgacgctttctctttctgacaaatcgaacacgcctacagagccgaaggaccacggcctagttttaactttccgtgtgcgaggtaggagttgggactaaaacgtggactcgtaacggnggtacagtgtctttagattttcggacgggaccgtaaaggggacttaagtcgggtacctaaccggttcttccctttacgacgtcccgttacccaaccggaaacgggtcccctaaagttccgggttacccgtttccccccgtacggtccgccccgtttcgccgttaccggaacggtaacggtaccgtaacccgttaccggaacggaccgacgaacgaccggtccgggtaccccgtagggtaccttcggtacccttacggggtaccaaacgggtacccgttaccttacccgtacgttacgtacgtacgtactacgggacggcggacgtgaaccgg

SEQ ID NO: 200354 - DNA, 692 bp, Homo sapiens
  misc_feature: GYAE6OF02HLKD6.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagtgtttcttactatgggctggatccggcggcccccgggaaggcctggagtggttgggcagtgtccaatacggtacgaccctccccactaccgcccccatcccctcgacggggtccgcctcgtacgttgtacaattcgacctaccgtctaaacgaagtctagttctctcgtggtctgtacttctgtccaccgccgacgacaccggccacgtactactagttcgtcgtccgtacggacacgtagtcgggccctaaccggtacccttaccccgttttcgtccgttaccggtccggggggaccgggttaactccgggttacgttcccgtaacccggttcctacccgttccgacgtccccgtacccgaacccggtaaccgggcccctaacggttccccggttcccctttccccccggttacggcccctaacccccgttccctaacccgtaacgccgtaccccg

SEQ ID NO: 200355 - DNA, 771 bp, Homo sapiens
  misc_feature: GYAE6OF02JNZH7.25.78.H01.1.454.CMB.1.raw
  modified_base (239)..(239): a, c, t, g, unknown or other
  misc_feature (239)..(239): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgacggccctcggaaaccctcgtccctcgcttgcactgtctcttcgactccatcagtagttntttctactagtgggctggatccgggccggcccccgggaagggcctgggaggtcggttgggctaggtcgtccgaatacgggtacgaccccttcccacgtacccgccccagttcccctacgacggggtccgccgtcgacgttcgtactacgttgacctacctacgtaaagagcctaagttcctacgttcgtcgggtcttacgtactttcgtacgttcccgaccgcccggtacggaaccgtaccgggacccaacgtaacttacggttaacttcggttacgttccgtacggaacctaacgtaccggtcgggtacccgtaccgtaacccgttaccccgttttcctaccgttaccggtacgggggacccggggtaacttcccgggtacgggtacctacccggtttaccgtcccgttccgaaccgtccccgttacccgaaccggaaaccccggggtccctaaacggttccccggttcccctttaccccggcccggttaccctacccccgtacccgttaacccgacggcccgtaaccccg

SEQ ID NO: 200356 - DNA, 635 bp, Homo sapiens
  misc_feature: GYAE6OF02FGJG0.25.78.H01.1.454.CMB.1.raw
  modified_base (237)..(237): a, c, t, g, unknown or other
  misc_feature (237)..(237): n is a, c, g, or t
  modified_base (350)..(350): a, c, t, g, unknown or other
  misc_feature (350)..(350): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctcttcgactccatcagtagttntttctactgttggggctggactccggcgggccccgggaaggcctggagtggttgggcagtcgtccaatacggtacgaccctccccactaccgccccactccctcgagggtccncctcacgttgtcaattcgactacctacaagaacgctagttctctcgtgggtctgtacttctcgtccaccgccgcggacacggccacactactattgtcgtctacggacacgtagtcgggacccgaaccgaccttacccctttcgtaccgtacggtcgggggaccgggtaatcggtcgtccgtacccgtctcctccgacgtccctaccaccgaacgggccctaacgtcccggttcccttaccccgtcggtacccctaccccgtccctacccgaacgaccgtacccg

SEQ ID NO: 200357 - DNA, 921 bp, Homo sapiens
  misc_feature: GYAE6OF02JK8GE.25.78.H01.1.454.CMB.1.raw
tcagactgtacagtcacgaccggtgctcgatttagtgtgagtagtttgggtttggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagttagttgtttcttacgttagttggggtcttagggactcccgggtcccgggaccccccgggggaaagggtcccgtaggggacggttcggggtttcggggtaccgtaacggttccggttacccgtaaaaggttaccgggttacggaacccccgttaccccccaacgttaccccgggacccccctaccgttccccccttaccggaacggggttcccgccgtttaccgaaccggttttcggttacctaacgtttcgaaccctacccgttacgaaacggtaacgtaccgttaacggttccttaaccgtttccgttacggggtcctttacgggtacctttccgttcgtacccgtacccggcccggtaccggtaaccacccgggtaccctaaatccggtttaaccttacgtttaggttccgttacccgttaccggaacctaccgtagggttaccggggtaccccgtaaaccggtaaccccctttacccgtttacgtttccccgtaaccgggttcccgggggtaccgggttaacgttccggtttccgggttaccctaccccgggtttacttccccgtacgtaacccgtacccttccccggaaaccgggtaaccccggtccgtacccgttccggttcccccgttacccccgtcggtaccccttcccccgtaaccctcccggtaacgtacccgtacccgg

SEQ ID NO: 200358 - DNA, 641 bp, Homo sapiens
  misc_feature: GYAE6OF02HO19Z.25.78.H01.1.454.CMB.1.raw
  modified_base (238)..(238): a, c, t, g, unknown or other
  misc_feature (238)..(238): n is a, c, g, or t
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagttntttcttactagttgggctggatccgggccggccccgggaagggcctggagtgggttgggcagtgtacaatacggtacgaccctcccactaccgccccatccctcgacgggtccgcctcgtacgttgtacaagttcgaaccacctactaaacgagctagttcttctcgtgggtctagtacttctgtccaccgccgacggacaccggccactaactactagttgtactcgtacggacacgagtcgggccacgtaaccctttcccgtttctacgttaaccggcgggggtacccgggtaattcggtcggtacccgtacccgttctccttcgacgtccctaccgaaccggtacggccctaggtcccgttccttccccgtgacccctacccgtcctaccgagaccaccg

SEQ ID NO: 200359 - DNA, 225 bp, Homo sapiens
  misc_feature: GYAE6OF02IFTKM.25.78.H01.1.454.CMB.1.raw
  modified_base (210)..(210): a, c, t, g, unknown or other
  misc_feature (210)..(210): n is a, c, g, or t
  modified_base (212)..(225): a, c, t, g, unknown or other
  misc_feature (212)..(225): n is a, c, g, or t
tcagactgtacagtcacgaccggtgctcgatttagtgtgagtagtttgggtttgggtgcccaagctgctggagggcacggtcaccacgctgctgagggagtagagtcctgaggactgtaggacagccgggaaggtgggcacagcggccctgggctgcctggtcaaggctacttccactgtacagtctgagcggctggcaaggcgctatgntnnnnnnnnnnnnnn

SEQ ID NO: 200360 - DNA, 1028 bp, Homo sapiens
  misc_feature: GYAE6OF02H4VIX.25.78.H01.1.454.CMB.1.raw
tcagactgtacagtcacgaccggtgctcgatttagtgtgagtagtttgggtttggggccttctgagagtcatggacctcctgtggaagaacttgaggcacctgtggtctgctcctatggtggcggctccagatgggtcctgtcccagctgcagggtacgtccgggccaggtcgtggtcgacggccccgttaacggaaaccccttccgtccgtcgttcgtcgaccgttcgttcgtacgttccgttacgtacctactacgtacgttaggttcggtttactttacgttaagttcggggtcggtaggtcgtacccggtcccggggaccccgggtaaccggggtcgtaccggtagggttacggtttcggggtacggacggttacggttaccgaaaccggttaaacggttacccgggtaacctaccccctaaccgtaacccgtacccccggtcccttaccgttaccggtaacggggtcccgggtaacctccgttacgttacgttacgtacgttaaccgtaaccgtaccgttaaactaacggtaaacgttccggttacgtttaccgttccgttcggtaccgggtttagacccgtttacggtttccttacggttacccggtaccccgggaaccggtccgggtaacctacccgggtacccgtaaccttaacggttaacctttagtttaacggttcggtccggttaaacccggtaaccaccggttaaacccgttacgggggtaccctaaacccggttacccgtttaacccgtttcccgtaccggttaaccgggttaccggggggtaccccggtaacgggtttaaccggtccgggtttaaccccgttaacccgtttacggcccccgtttaccggttaacccgaaccccgtttacccggtaaaccccgggtaaaaccgggtcccgttaacccgggttttcccgggtaccccccgtttttaccccggacccgggtaccttacccccccgggttaaccgtacccggttaaaccgaccgggttaacccgttaccccccggggg

SEQ ID NO: 200361 - DNA, 712 bp, Homo sapiens
  misc_feature: GYAE6OF02JYI8T.25.78.H01.1.454.CMB.1.raw
tcagactgtacagtcacgaccggtgctcgatttagtgtgagtagtttgggtttggggccgttctgagagtcatggacctcctgtggaagaacttgaggcacctgtggttctgcctcctactggtggcggctcccagactgggtcctgtcccagctgcaggagtcgggcccaggactggtgaggccctacggaaaccctgtccctcgcttgcactgtctctttcgactccatcagtacgtgtttctactattgggctggatccggccggccccggtaaggcctggacgtggtaggcgacgtgtaccgaagtacggtagtacctccccgaactcgcccctacgtccctacgacggtcgtacctctaacggtgtcctagttacgacaccgttacaagaacgctaacgttctaccgtcgtcggtctagtacctttctcggttacccaccgccggtcgaacccgtacggaccctaactacgtaccttaagttcgtacggtcctacggaaccactacgtacggaccggtccgtaaacccttacccgtttacctacgtaacggttccggggtaccgggtacgtcggttcggtaaccgtaccgttccgccgtttaccgactcccgttacgacccggaaccgggtccctacgtaaccggttcccgtttcccgtaaccgggtcccaaacccgttccccttaccgaacgtcccggtaaccccg

SEQ ID NO: 200362 - DNA, 780 bp, Homo sapiens
  misc_feature: GYAE6OF02GZFBX.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctcgtccctcgcttgccacgtgtctcttccgactcatcagtagttgtttcttactagttggggtcgtggacgtccgggcccgggaccccccgggggaacggggcccgtgggacggttggggttggggccgtaggtcgtacccgaaacgtaaccgggtaccgaaccccttccccccgaacgtaccccgtaccccccacttccccccgtacggtaccgggggttcccgcccgttacctaccgttcggtacctaagttacgacctacctactaaaggaactccgtagttctccttcggttggtcttacgtccttacgttcgtccgacccgccggaccgggacccgaccgggcccaacctaactacttaagttcgtagttcctacggacacgtaggccgggacccgtaccgtacccctttacccctttcctacccgttacgggtaccgggggaccgggtacgttccggttcgggtacccttacccgtcctcctcgacccgtcccaccgaccccggaacggaccccttacggtccccggttaccccgttacccgccgtacccgtaccccttacccacgaccgtacgtcccg

SEQ ID NO: 200363 - DNA, 935 bp, Homo sapiens
  misc_feature: GYAE6OF02ISJLB.25.78.H01.1.454.CMB.1.raw
  modified_base (156)..(156): a, c, t, g, unknown or other
  misc_feature (156)..(156): n is a, c, g, or t
  modified_base (235)..(235): a, c, t, g, unknown or other
  misc_feature (235)..(235): n is a, c, g, or t
  modified_base (648)..(648): a, c, t, g, unknown or other
  misc_feature (648)..(648): n is a, c, g, or t
tcagactgtacagtcacgaccggtgctcgatttagtgtgagtagtttgggtttgggggcctttctgagagtcatggacctcctgtggaagacttgaggcacctgtggttctgcctcctactggtggcggcctccagatggtcctcgtcccagctgngaggacgtccgggccaggcgtggtgacgcccgtacgaacctcgtccctcgtcttgcactctccttcctttacgacctcnctacgtagtacgtttgtttacgttacgttaggttcgggcgttcggaccggtcccgggccccggggacccccggggtagggtaccgtgggtacggttcgggtggccgtcgtcgtacctaaggtaccggttacccgtcccctaccccgtaacgtaccccgtcccctaccgtccccgtaccgggtaccgggtcccgcccgttaccgttacgttcgttacctagttaccgacctacccgtaacgtaacgacgttacgttacgttaccgttcgtttacggtcggttacctttagtaccgtttccgtacggtacccgtacccggggtcccggtaaccggaacccggaacccggtacccttaaactaccgttttacgttttacggtttaccggttacggttaacccgttaaccggtaacnccggttaaaccggggttccccgggaacccggtttacccggtttaacccccttttacccccggtttacgtacgggttaaccccgggggttacggggtacccggggttaactttcccgggaccggtttaaccctcccggttacccttccggttaacccacccggttccccgtaaaccggtaaccccggaacggttacccccgttcgggtttaccccgttccccccgtttcccggtacccgtaccccgttacccgtacccgttaacgggaacccggtccgttaacccggg

SEQ ID NO: 200364 - DNA, 823 bp, Homo sapiens
  misc_feature: GYAE6OF02GSE5U.25.78.H01.1.454.CMB.1.raw
tcagactgtacagtcacgaccggtgctcgatttagtgtgagtagtttgggtttgggggccttctgagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgctactgtcttctttcgactccatcagtagttgtttcttactagttgggtctaggacgtccgggcccggacccccggggaagggcccgtgggaggtgggttgggctaggtgtaccaagtacggtacgtaccctaccccactacccgcccccactccccgtacgacgggggtccgtcccttacgtacgttacgtctaacgttcggtaccctaaccgttacgtaaaacgaacgttcgtaacgtttccgttaccgtcgttacggggtccttcgttaacctttccgttaccggtaccgtaccccgggcccggtaccgggaacccgtacccgggtaccccaacgtaacttactttaagttacggttcgttaccggtaccggtaaccaccgtaaggtccgggacccgaaccgttaaccctttacccccttttcgtaacccggttacgggtccgggggtacccgggtaagttccggtacggttcccgtaacccgtccgtttacccgtacctacccggtacccgtaacccgtaacccggaaccggtaccccgttaacgttccccggttaccccgttccccgtcggtacccctaccccgttccgaacccgtacgtaccgtacccg

SEQ ID NO: 200365 - DNA, 789 bp, Homo sapiens
  misc_feature: GYAE6OF02IZFEH.25.78.H01.1.454.CMB.1.raw
  modified_base (72)..(72): a, c, t, g, unknown or other
  misc_feature (72)..(72): n is a, c, g, or t
tcagactgtacagtcacgaccggtgctcgatttagtgtgagtagtttgggtttggggggccttctgagagtnatggacctcctgtggaagaacttgaggcacctgtggtctgcctcctactggtggcggctcccagatcgggtcctagtcccagctgcaggtagtcgggtcccaggtactggtgaggccctacggaaaccctgtccctcgacttgctactgtcttcttcgactccatcagtacgttgtttctactagttgggactgagtccggccggcccccgggaggtccgtacggtacgtgggtttcggcgtaacgttcgtaccaaacgttaccggtaaccgtaccccttaccccgaaccgtaaccgaccccccgtagttcccccggtacggtacggggtccgtcccgttcgaaaccggttcggtactacttacgaaccgtacctaccgttaagaaccggctaacgtttacctcgtccgtttagggttacttacgtactttaccgttaccggtaacgtaccccggacccggtcggaacccgtaccggaccctaacggtactaccggttagttacgtacgttaccgtacggaaccgtacgtacgtacggggtacccacgtaaccctttacccccgtttatccgtaaccggtccggggacgggtaccttcggtaccgaccgtccggttacctcgtacgcctcgtacccgaacgacgggtaccctaacttcccgggtacctttccccgtccggtacccgtaccctcggtacccgtaacggtctaccccgg

SEQ ID NO: 200366 - DNA, 589 bp, Homo sapiens
  misc_feature: GYAE6OF01EOTTE.51.3.A03.1.454.CMB.1.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
tcagcgatcgtatacacgaccggtgctcgatttagagagcgtcacagggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaaagcaatatgcttactggtaccagcagaagccaggccaggcccctgtcttggttatttanaaagctttgagaggccctcagggtaccccngacgcgtattctcgtcgctccagctcacgacgaacaacacgtactacgtcgacctactacgtaggtcggacgtaccgaggacgaggacgggacggaggtcgtagtactactttacgtgtacagtactaactacgacgaacgagacgtagtcgtactacgttagttcgttacgttacggtacgggtacgggtaacgggaacccgtaaaccgtaccggtaacccggttaccgtaacggtaccgaaccggacccgaaacggtcccgtcccgg

SEQ ID NO: 200367 - DNA, 584 bp, Homo sapiens
  misc_feature: GYAE6OF01AB3QI.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctcccctcctcactctctgcacaggctctgaggcctcctatgagctgacacagccaccctggtgtctgtgtcctcaggacagacggccaggatccacctgctcgtggagatgcattgaccaaagcaatatgcttatggtaccagcagaacgccggccaggcccctgtgttggtgatgtataaacgacacgtgagacggccctcgagggactcccgtgacgtcgtattccgtcgtcggcctcgacggtcgagggtacacggtcacagttcggacctagtcgaggtggacgtccgaggcaaggaggacgaggctagtactagttattcgtacaagtaccaacacgaaccaccgtagtttacggttaactttagttcgttaccgttacggaactcgacgaccgaaggtcctaccggttaccgtcggggtaccaccggtaccccgaaccggacccctaaaccccgcttccgtaccttacccg

SEQ ID NO: 200368 - DNA, 535 bp, Homo sapiens
  misc_feature: GYAE6OF01EGAC2.51.3.A03.1.454.CMB.1.raw
  modified_base (331)..(331): a, c, t, g, unknown or other
  misc_feature (331)..(331): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaaagcaatatgcttactggtaccagcagaagccaggccaggcccctgtcttggtttatttataaagtactttgagacggccctcacgggacccctgagcgattcnctggctcagctcagcgaacaacagtcacgttgaccatcagtggagtccaggcagaggacgaggctaggacttattaccgtgtacagtcatcagacagcgagtggctactttatcgttcgttaagttccgggacggtaagggaaccctaaacgtcgacccgtcgtaacggtcacggtaccccaagggcctccggccccgttccgg

SEQ ID NO: 200369 - DNA, 513 bp, Homo sapiens
  misc_feature: GYAE6OF01A2OR8.51.3.A03.1.454.CMB.1.raw
tcagcgatcgtatacacgaccggtgctcgatttagagagcgtcacaggggctgtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcaggccaggccctgtcttggttatttataaagactttgagaggccctcagggacccctgagcgattctctggctccagctcagcgacaacagtcacgttgaccatcagtggagtccaggcagaggacgagggctagactattactgtcagttcatcagacagcagtggcactttatgttcgtagtttccgggcggtagggaaccaaacgtcgacccgttccgtaacggttccaaggtccccgaaaggctaccccgg

SEQ ID NO: 200370 - DNA, 641 bp, Homo sapiens
  misc_feature: GYAE6OF01CAM81.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctcccctctcactctctgcacaggctctgaggcctcctatgagctgacacagccaccctcggtgtctgtgtcctcaggacagacggccaggatcacctgctcgtggagatgcattcgaccaaagcaaatatgacttactggtaccagcaagaagccaggccacggcccctgttctttggttatttataaagtactttgagacggcctagacggaccctgacgcgtattctacgtggctccaggtctacgacgaccgaacaacgtacgtactaacgttacgaacctagtcgtaaggtcgggacgtaccgaaggcgaaggacggacggacgggtcacggtaacttaagttaccgtgtaccgtagtacaattacgagaacgtacgaccgtaggtacggacttaacgtttagtacggttcggttaacgttccgggaacgggtaaccgggtaaccctaaacggtccggtaacccgttaccggttaacggtccgtaacccggacccggtaaagggtcccttccccggcccccgttaccggg

SEQ ID NO: 200371 - DNA, 518 bp, Homo sapiens
  misc_feature: GYAE6OF01A9MQN.51.3.A03.1.454.CMB.1.raw
tcagcgatcgtatacacgaccggtgctcgatttagagagcgtcacagggggctgtgggtccaggaggcagaactctgggtgtctcaccatggcctggatccctctacttctccccctcctcactctctgcacaggctctgaggcctcctatgagctgacacagccaccctggtgtctgtgtcctcaggacagacggccaggatcacctgctctggagatgcattgaccaaagcaatatgcttactggtaccagcagagccaggccacggcccctgtcttaggttatttataaagtactttgagacggtccctcgacgggtacccctgagcgtattctcgtggctccgagtctcagcacaacgagtcacgttgacatcgagtggagtccaggcaggaggacgagctagactatacgtgtacagtcatcagacagcagtgctattatgttcgtagttcgggacggaggtaaccaacgtcgaccgtaccgtacggtcaacgtcccgaaggtcctaccccgg

SEQ ID NO: 200372 - DNA, 561 bp, Homo sapiens
  misc_feature: GYAE6OF01AUZH9.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtgtcctcaggacagacggccaggatcacctgctctggagatgcattgccaaagcaatatgcttactggtaccagcagaagccaggccacggcccctgtcttggttatttataaagtactttgagacggccctcgacgggacccctggagcgtattcctcgtggcctccagcctcgagcgaacaacagtctacgttcgaaccatcagtggacgtccgaggacaggaggacgaggctgtactagttactgtcagtcagtcagacagctaggtcgctacgttatcgttacggtacgttcgggacgggaacgggtaaccctaaaggtcggtaacccgttacgtacgggtcaaccggacccgaaacggcccgtccgcccccgttaccgg

SEQ ID NO: 200373 - DNA, 751 bp, Homo sapiens
  misc_feature: GYAE6OF01BHMFE.51.3.A03.1.454.CMB.1.raw
  modified_base (217)..(217): a, c, t, g, unknown or other
  misc_feature (217)..(217): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagaccggccaggatccacctgctctgganatgcattgaccaaagcaatatgtcttacgtggtaccagcaagaacgccgaggccacggtcccctgttcgttaggtttaatttataaacgtacgtttaggaggacggtcccggtccggggtacccctggacgcgtactttcgtcgtcggtcctccgagtcctacgacggtacgaaccaacgtacggtacctacggtttacgaaccctagtacgtaaggttacgggaccgtaccgagggtaccgaagggacgggtaacggacgggtactacggtaacctttaagtttaccgtagtacgtaacgtctaacgtacgaacgaacgaacggtacgtagggttacgtaaccgttaactttacggtcggtttaaccggttaccggttaccgggggaccggggttaaccgggtaaaccccgtaaaaccggtttcccgggtaaaccccggtttcccggttaaacggggttacccaaccccgggttaccccggaaacccgggttccccgtcccccgggttcccccccggttacggttacccccgg

SEQ ID NO: 200374 - DNA, 732 bp, Homo sapiens
  misc_feature: GYAE6OF01DEE8Y.51.3.A03.1.454.CMB.1.raw
  modified_base (240)..(240): a, c, t, g, unknown or other
  misc_feature (240)..(240): n is a, c, g, or t
tcagcgatcgtatacacgaccggtgctcgatttagagagcgtcacgaggggctggtgggtccaggaggcagaactctgggtgtctcaccatggcctggatccctctacttcctccccctcctcactctctgcacgaggctcctaggcggtcctcctatgagctcgacacacgccaccctcggtcgtcctgtcgtcctcgaggacacggacggccaggactcacctcggctcgtaggaagntcggctacgttgaccgaaaagtcctaattactcggtactttaaccgtacggtaaccacgacaacggaacgacccgtacgaccgacggtcccttggttacgtttaggtttaatttaaagtaaacgttacgtttacggacggtaccggtcccgtacggaccggtaccctggacgtacgttcttccgtcgtcggccttaccgcgtacctacgaacggaccaacgaaccgtacggtaccgtaaccggttcgaactacgtcggtagggtacggtacgaccggaagggacaacgggtacggtacggaacgtcgtaagtaccttagttctaggtcctagtacctagaccgacgtaacgacgtcgttaaggtcgtaacttcggtttaactcgggtaccgttaggttaccggggacggtaaaccgggtaacctaaaccggccggtaaacccgttaccggtacgtaccgacccggtaacgaacccggttccgtacccccggg

SEQ ID NO: 200375 - DNA, 693 bp, Homo sapiens
  misc_feature: GYAE6OF01BZQSY.51.3.A03.1.454.CMB.1.raw
  modified_base (287)..(287): a, c, t, g, unknown or other
  misc_feature (287)..(287): n is a, c, g, or t
tcagcgatcgtatacacgaccggtgctcgatttagagagcgtcacagggggctgtgggtccaggaggcagaactctgggtgtctcaccatggcctggatccctctacttctccccctctcactctctgcacaggctctgaggcctcctatgagctgacacagccaccctcggtgtcctgtcgtcctcaggacagacggccaggatcacctgctcgtggagatgcattgacccaaccattattcttattcggtaccagcagaacgccaggccaggcccctgtgttgtnatatataaagcatgagacgtccttacgaggactccctgagcgtattctcgtcggcctccacctcgaggggaactaagtggtaccactatttacggaacctagttaccgaagggttcggaacggttacccgaagggtacccaaagggaaacggaccggaacgggtaccgttaggtaacctttaagttttcccgttaggttacctaaacgtttccgtttaaccgaacggtaaacctagttaccggtaaggtttacggttaacttttaagttacggtttaccggtttacgggtaaacccgtttcgggggaacccctaaaggggttaccctaaccccggttacccggtaagggttacccctaaacggaccccgttaaacgggcccccaaaacccccgtcgtttaacccgg

SEQ ID NO: 200376 - DNA, 796 bp, Homo sapiens
  misc_feature: GYAE6OF01C4IN4.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacacgcccacccgtcggtgtctgtgtcctcgaggacaggacggccaggactcacctgctcgtggagatgctagttcgaccaaagcaatatgtcttacgtacggtaccagacaagaacgccgacggccgacggtccccttgttaccgtttaggtttaattttaaagtaaacgtactttaggaacggtaccggtccctacggtaaccgggtaccccttaggacggtacgtaacgtttccgtcgttcggtcccttaccgaacggtccctacgaacgaccggaacctaacgtacgtaccgtaccggttacgaacctacgttcgaacggttcggacgtaccggagggaccggtaagggaacggggaacgtacgggtccttaacggtaacctttaacgtttaccgtagttaaccgtaacgttccaagttaccgaaagtaccgacggtacgtaagggtccgggtaactttaacgtttacgttacgggtttacccgggttaaggtcccgggggtaaccgggaaaccgggttaaaaccccgtaaaccgggtttacccggttaaccccggtacggttaaccggggttacccaaccccggggtaacccgtaacccgggtcccctcccccgggtccccccgtttaacccggg

SEQ ID NO: 200377 - DNA, 686 bp, Homo sapiens
  misc_feature: GYAE6OF01BISPU.51.3.A03.1.454.CMB.1.raw
  modified_base (101)..(101): a, c, t, g, unknown or other
  misc_feature (101)..(101): n is a, c, g, or t
  modified_base (239)..(239): a, c, t, g, unknown or other
  misc_feature (239)..(239): n is a, c, g, or t
  modified_base (305)..(305): a, c, t, g, unknown or other
  misc_feature (305)..(305): n is a, c, g, or t
  modified_base (656)..(656): a, c, t, g, unknown or other
  misc_feature (656)..(656): n is a, c, g, or t
tcagcgatcgtatacacgaccggtgctcgatttagagagcgtcacagggggtgggtccaggaggcagaactctgggtgtctcaccatggcctggatccctntacttcctccccctctcactctctgcacaggctctgaggcctcctatgagctgacacagcccacccgtggtgtcagtcgtccccaggacagacggccaggactcacctgctcgtggagatgctattcgaccaaacgtntatgtactttagtggtaccagcgaacgaacggcccgggacaccggtcccgttggtcggttagggtntaagttaggtaaattaaaacggctaacgtaggacggacggtaccctacggaaggtacctccgtaggaggtaccgtacgtttccgtcgtacggtccttaccggaggtaccggaacgggaaccgtacggtacacgtacgttcggacctagtacgaggtggtacgtaccgaggaccggagacgggacgagtccgtagtaactttagttacgtacgtaactaacgtacaacgaacggaactaccgtaagtttacgtaactttacgtacgttccgttaacgaactcggtaccgacgttaccggtcgtacccggtcgagggtaccacccggtacccgaaacggcccctaaaccccgngttaccgaccttcccgttccgttacccccg

SEQ ID NO: 200378 - DNA, 630 bp, Homo sapiens
  misc_feature: GYAE6OF01CGPM1.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctctcactctctgcacaggctctgagcctcctatgagctgacacagcccacccgtggtgtctgtcgtcctcgaggacagacggccaggatccacctgcctctggagatcgctattcgaccaaagcaatatgtcttacgtgtaccagacaagaacgccgacggccgacggcccctgtcgtttaggtttatttaataaagtacgtttagaggaccggtccgtacgacgggtaccccgtagacgtcgtaacttcgtccgttcggtcctaccgacggtcctacgacgtacgaaccaacgacgtacgtacgttacgacctatcgagtcggtacgtccgagcgaagacggacgaaggctacggtacttaacgttacgtacgtacgtagtcctaagttcgaacgtacgacgcgtaagtcggacttacgttagttcgttacggttagtcggggacggtacgggtaaccctaagacggtacccgtaccgacggtccgacgacccgagtccgtcccgtccccgtccgg

SEQ ID NO: 200379 - DNA, 708 bp, Homo sapiens
  misc_feature: GYAE6OF01A6S0P.51.3.A03.1.454.CMB.1.raw
  modified_base (267)..(267): a, c, t, g, unknown or other
  misc_feature (267)..(267): n is a, c, g, or t
tcagcgatcgtatacacgaccggtgctcgatttagagagcgtcacagggggctgtgggtccaggaggcagaactctgggtgtctcaccatggcctggatccctctacttctcccccctcctcactctctgcacaggctctgacggcctcctatgagctgacacagcccaccctggtgtctgtcgtcctcaggacaggacggccaggactccacctgcctcgtggatatgcagttcgaccaaagcaaatatcgcttactcggtaaccngcaagaacgccacggccacggcccctgttcgttggttaatttaagtaaagtactttgacgtacggccctcgaccgggacccctgacgtacgtacttcgtcgtcggcctccgacgcctcgaacggaccgtaaccaacgtacggtaccgtacggtttcgaacctacgtacgtacggtacgggtacgtccggtaacgggaccgtaagggaacgggaaccggacggtaccgttaacgtaaccgtttaagtttaccgtggtaacgtaccggttaccaacgttaaccgaaggtaacccgtaacggacggtaacggtagtaccgttaactttacggttcgttacggtaacggtttccggggacgggtaaccggaaccgttaaacggtccggtaacccgttaccgtacgggtacccgtaacggaccccgtaaggtcccggttaccccgg

SEQ ID NO: 200380 - DNA, 598 bp, Homo sapiens
  misc_feature: GYAE6OF01EZ157.51.3.A03.1.454.CMB.1.raw
  modified_base (220)..(220): a, c, t, g, unknown or other
  misc_feature (220)..(220): n is a, c, g, or t
tcagcgatcgtatacacgaccggtgctcgatttagagagcgtcacagggggctgtgggtccaggaggcagaactctgggtgtctcaccatggcctggatccctctacttctccccctcctcactctctgcacaggctctgaggcctcctatgagctgacacagccaccctggtgtctgtgtcctcaggacaggcggccaggactccacctgctcgtgganatgcattgaccaaaagcaaattatgtcttactcggtaaccagcaagaagccacggccacggcccctgtcgtttgttattaataaagtactttgagtacggccctcgacgggaccctgacgcgattcctcgtcggctaccgagtctcgaacggtcgaaccaaacgtacgtacctacggttacgacctagtacgacggtacggacgtacccgaggacgaaggacgggacggacgggtctacgaaccttatttacgtagtcagtctaactcgaagactaacggctaggtgtactacttagtggttacgtacgttcgggacggtaacgggaccctaaacgtcgtaacccgtccggtaagtcaacggcccgaaggctccccgg

SEQ ID NO: 200381 - DNA, 688 bp, Homo sapiens
  misc_feature: GYAE6OF01A44Y7.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacacgcccacccgtcggtgttctggtcgtcctcgagggacaggacggccaggactccacctgcctcgtggagatgcattcgaaccaaagcaatatcgtcttactggtacagacgagaacgccgacggccacggtcccctgttcttgtttatttaataagtactttgagacgccctagaccggacctggcgtcgtattcctcgtcgctccgagtctgacgcgaactaacgagtcctacgttacgactagtacaggtgacgtcgagacgaggaaggacgagtcgtagtaacgttattacgtagttaccgagtttacacgttacgacgtaaccggacgtacgggtacggttacggtacttaacgtttacgtcggtttaccggttacggttaccggggaacggggaaccgggtaaacccttaaccgggtacccggttaaacccgggttacccgggtaaccggttaaccccggtaacccgggtaccccggtaaacccggggttccccttcccccgggtcccccggttaacccccggg

SEQ ID NO: 200382 - DNA, 633 bp, Homo sapiens
  misc_feature: GYAE6OF01DX1JO.51.3.A03.1.454.CMB.1.raw
  modified_base (225)..(225): a, c, t, g, unknown or other
  misc_feature (225)..(225): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (365)..(365): a, c, t, g, unknown or other
  misc_feature (365)..(365): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacacgcccacccgtcggtgtctgtcgtcctcgaggaccagacggccaggactccacctgctcgtggagntgctagttcgaccaaagcaatatcgtcttacgtcggtaccagcagaacgccgaggccccgaggtcccctgttcgtttagtttaattaagtaagtacttggagcgtccncgacggaccctgngcgtactctcgtgcctcgngctacacgacgaacagcgtcacgtacactagtcgagtgacgtacgacggagacggaggaacgacgtcgtacgtacgttacttacgtgtacctaacgtacaacgaacgaaccctaaccgtagtttacgttactttacgtcgttaccgttacgtaacgtccgtaaccgaccgtaacgttacccggtacccgtacggttcggtaccgacccggtaaccccgaacccggtaccccctaaaccccgacgttaccgtccgtaccgttacccccg

SEQ ID NO: 200383 - DNA, 910 bp, Homo sapiens
  misc_feature: GYAE6OF01DU60J.51.3.A03.1.454.CMB.1.raw
  modified_base (79)..(79): a, c, t, g, unknown or other
  misc_feature (79)..(79): n is a, c, g, or t
  modified_base (103)..(103): a, c, t, g, unknown or other
  misc_feature (103)..(103): n is a, c, g, or t
  modified_base (289)..(289): a, c, t, g, unknown or other
  misc_feature (289)..(289): n is a, c, g, or t
tcagcgatcgtatacacgaccggtgctcgatttagagagcgtcacgagggggtgggtccaggaggcagaactctgggtntctcaccatggcctggactccctnttaccttcctccccctctacactctctgcacgaggctctggacggcccttactagtgagctagaacacgacgtccctaccgtcggtcgacgtacggtcctacccgaggacacgggaccgaccgaggactccgtaactcggtccttaggaggtagtagtcgacgttacgtaccgaaccctaaaacgngttacgtcggttactttaacggtaccggtaaccgcggaacgaaccggaaccggggcccgggtacccgacccggttccgttgggtgggttaaggtacgtaagttaagtttaaagaaaccgtcgtacggtacggaaccggaccgtccggtacgaaggggtccttaccggagggtacgtaccggttacttcccgggttacgtcgggttaccgtaacccgggtaacggtaccgggggttaaaaccggaaaacccggtttacggtaacccgtaacgttacccgggttaacggtcctaaacgggtaccggggtaacgggtaccggggttaacccgtaaccgggggaccgggtaacggggaaaccgggtaaccggggtaacgggtacggtaaccgggtttaccgttaaacgttttaacggttaacgttaacgtaacgttaaacctaacccgttaaagaccgttaaactaacggtttacgtttacgtactttagggtaccgtttacggtaaccgtacgtacccggtaacgtaccgttaacggtaccgtacccggtccgggacttaccggaccgtaacccggacccgtacccgtaccgtactacccgtccgttacgttcccggtcccccg

SEQ ID NO: 200384 - DNA, 859 bp, Homo sapiens
  misc_feature: GYAE6OF01AS1XW.51.3.A03.1.454.CMB.1.raw
  modified_base (215)..(215): a, c, t, g, unknown or other
  misc_feature (215)..(215): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctggtgtctgtgtcctcaggacagacggccaggatcacctgctcgtgganatgcattcgaccaaagcaatatgtcttacgtcggtaccagaccgaagaacgccgaacggcccaaccggtcccccttgttaccgtttagggtttaacttttaaagtaaaacgtaccgttttaggaacggtaccggtccccgttacggaccgggtacccctggaacggtaccgttacgtttccgtccgttacggcccttaccgacgtcccgtacgacggaccgtaaaccgaacgtaaccggtaccgtaaccggttacgtaccctaacgttcggtaacgggttacgggtaccgtacccggtaagggaccgaaacggggtaacggggtaaccggtaacgggttaacccttttaaccggttaaacgttttaccgttacgggttaccgttaaccgtttaccgtaacgttaaccgaacggtaaccgaacgggtacccggtaagggttaccggtactttaaccgttttacggttaccgggttaaccggtttaccgggttaccggggaaccggggtaaaccgggaaaccccgttaaaacggttcccgggtaaaccccggtttacccggttaacgggtaccccgtaacccggtaaccccgggttaaaccggtcccgttacccccgggtaccccccggttcccgggttaaccccg

SEQ ID NO: 200385 - DNA, 717 bp, Homo sapiens
  misc_feature: GYAE6OF01EF58Q.51.3.A03.1.454.CMB.1.raw
  modified_base (176)..(176): a, c, t, g, unknown or other
  misc_feature (176)..(176): n is a, c, g, or t
  modified_base (234)..(234): a, c, t, g, unknown or other
  misc_feature (234)..(234): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
tcagcgatcgtatacacgaccggtgctcgatttagagagcgtcacagggggtgggtccaggaggcagaactctgggtgtctcaccatggcctggactccctctacttcctccccctcctcactctctgcacaggctctgaggcctctatgagctagacacgacgcccaccgtggtntccttggtcgtcctgacggacacggacggccaggtactccacctgctcgtaggagtancgtactacgttacgaaccaaagtcaaattgtcgttacttacgtacggaaccagacgaacgaacgccgacggccgaccgtccgttacgttcgtttagtttaattaacgttaaacgtcgttaggaccggaccgtaccgtaccggaccggtacccgtaggtcgacgtacttccgtcgtcgacctcgagccgtcacgtaaccggactaacgtacgtaccttacggtacgtacctagtccgtagggtcgaccgtacgacgggagaacgggagacgggagtcgttaagtactacgtttacgcggtacncgtanacgtacaacggtaagttcgaggtacggtctacgtttaacgttaccgggtgttaccgggttaggtacccggggaggtttaaaccccggaacgttaccccgggtacggttaaccccgaccggttaaggccccgtaaacccggcccgtacgggtccctcccccggaccccgtttcccgg

SEQ ID NO: 200386 - DNA, 732 bp, Homo sapiens
  misc_feature: GYAE6OF01A7SZZ.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactcggtacagcagaacgccaggccacggtcccctgttcttaggtttatttaagtaaagtactttggagacggtccctacgacgggaccccctggacgtcgtacttcgttacgttcggtcctccgtaagtcccgttacgaacgtaccggaaaccaaaccgtaacggttaccctaaacggtttaccgaaaccctaagttaccgaagggttacgggtaaccggttccccgaaaggggtcccgtaaagggaacgggtaaacgggtagggttacccttaacgggtaaacccttttaaggtttaccgtacggttcctaaacggttaccagttaaccgaagtaaccagggtactaacgggttcggtactaccggtttatcgggttaccgttaggttccgggaacggtaacgggtaccctaaacggttcggtaacccgttacgtaacggtccgaaccggtaccccgtaaggtcccgttcccggccccccgttaccgggg

SEQ ID NO: 200387 - DNA, 869 bp, Homo sapiens
  misc_feature: GYAE6OF01BQRO4.51.3.A03.1.454.CMB.1.raw
tcagcgatcgtatacacgaccggtgctcgatttagagagcgtcacagggggctgtgggtccagggaggcagaactctgggtgtctcaccatggcctggactccctctacttcctccccctcctcactctctgcacaggctctgacgtcctcctatgacgctgaaccacgacgcccacccgtggtgtacctgtcgtcctcaggacaggaccggccgaggacttccaaccgtgcctcgtaggagtattcgactagttcggaacccaaagtctaaattagtacggtacctttacgtacggttaaccacggacaacggaacgacccgaacgggtaccccgtaccgggtacccccgtttacgtttaccggtttttacgggttttaattttaaacgttaaaacggtttaccgttttacggaacgggtacccgggtcccccgttaaccggtaaacccggggtaccccctttagggaacgtaccggttaactttccggttaccggttccgggtacccttaccgaacggtcccgttaccgacggtaccggaaacctaacgtacggttaaccctacgggtttaccaacccgttactaccggttaacgggtaccgggtaacggttacccggaagggaaccgtaacggggaacgggaaccggagtaaccggttaagtaaacccgtttaagttacggttaccgtacgtaaccgtactaaccgtacgtaaccggacgacggttaaccgtaacggggttctaccgtttacggttagttacggtttaaccggtacggttaccggggacggggttaaaccggtacgtaaaccgtccggtaacccggtacgtacgtccgaaccggtccgtaaccgtccggtaccccg

SEQ ID NO: 200388 - DNA, 731 bp, Homo sapiens
  misc_feature: GYAE6OF01CUTYW.51.3.A03.1.454.CMB.1.raw
  modified_base (174)..(174): a, c, t, g, unknown or other
  misc_feature (174)..(174): n is a, c, g, or t
tcagcgatcgtatacacgaccggtgctcgatttagagagcgtcacagggggctgtgggtccaggaggcagaactctgggtgtctcaccatggcctggatccctctacttctccccctctcactctctgcacaggctctgaggcctctatgagctgacacacgccacccgtggtntctgtcgtcctcgaggacaggacggcctaggactcaccgtggcctgtaggatatgactattcgaccaaagctaagtactcgtacttacgcggtaaccagacaagacgccgaacgccgaacggttccccttaggttacctttagggtttaattttaaacgaaacggttaccgttttaggaacggtacccggtcccgtacggtaacccggggtaccccttaggaaccggtacgttactttcccgttaacgtcgggtacctccggaacgttccgtaaccgacggacccggtaaaacacgtaacggtccgtaacggttcaacccgtataccggaggttacgggactaccgagggacacgggaacggcgacgtacgtagtaaccgttattacgtcgtacgtaccgtataccaccgtaaggactaccggatagggtactactaacgttagtcgtacgttaggtcccgggaacgggtaaaccgacctaaacggttccggtaaacccggttcccggtacgggaaaccctcccgggaaacccgtagggttccccgttaacccccgg

SEQ ID NO: 200389 - DNA, 780 bp, Homo sapiens
  misc_feature: GYAE6OF01B1H6Q.51.3.A03.1.454.CMB.1.raw
  modified_base (102)..(102): a, c, t, g, unknown or other
  misc_feature (102)..(102): n is a, c, g, or t
  modified_base (125)..(125): a, c, t, g, unknown or other
  misc_feature (125)..(125): n is a, c, g, or t
  modified_base (130)..(130): a, c, t, g, unknown or other
  misc_feature (130)..(130): n is a, c, g, or t
tcagcgatcgtatacacgaccggtgctcgatttagagagcgtcacgagggggtgggtccaggaggcagaactctgggtgtctcaccatggcctggatccctntacttctccccctctcactctcngcacnggctctgagcctcctatgagctgacacagcccacccgttcggtgtctggtcgtcctcgaaggacaggaccggccgaaggtactacacccgtggccttcgtagggaatagttcggactaagttcggaaccaaaaggctaaaattacgtcggtacctttacgtacgggtaaccacggacaacggaacgaccgacggcccgaccgggtccccttaggtttaccgtttaggttttaactttaaagttaaacgttacgttttaggaacggacggttaccccgtacggaacccgggtaccccttgggaacgtccggttaactttccgttccggtacggtcctacccgtaaggtcccttacggaccgtaaccgaaccgtaactacgttaacgtaccgttaacgaacctactaccggtaggtacggtaacgaccgaggacgaaaggtaacgggacgtacggtacgttagtaaacccgttagtttcgtacgtaccgtaaggtctaacgttaccgaaagtaacccgcggaaacgttcggtacgttaactaacgtttagaccggttagttacgggtaccggacgggtaaccggacctaaacggtcgtaccggtacgtggacccgtacgacccgttaagcccggtacccgtccccgtaacgg

SEQ ID NO: 200390 - DNA, 744 bp, Homo sapiens
  misc_feature: GYAE6OF01B3WHD.51.3.A03.1.454.CMB.1.raw
  modified_base (173)..(173): a, c, t, g, unknown or other
  misc_feature (173)..(173): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccacccgtcggtntctgtcgtcctacgaggacagacggccaggactcactgctctggagatgctagttcgaccaaagcaatagtcgactttacgtcggtaaccagacgaaggaacgaccgacgggaccccgaccggtcccccttggttcgttttagggttttaacttttaagtaaaacggttaccgttttaggaacggtaccggtcccgtaccgaccgggtaccccctggacggccgttattccgtcgtcggtacctaccgtacgtcctaccacggaccgaaccaacgtacgtaccgtacgttacgacctacgtcgtaaggacgggtaacgtaccgacggtacgaaggaacggggaaccgagggttactagggtaactttaacgttccgttacgaccgttagtacttaacgtaaccgacgaacgacggtcgtaacgggtcgtaccgttacgtttacggtacgttacggttacggtccgggtaaaccgggaccggtaacccgaagttacccgggtacccgttacccggtaaggacccgtaaccggacccgtaaaccgggtcccgtcccggtcccccggttacccg

SEQ ID NO: 200391 - DNA, 780 bp, Homo sapiens
  misc_feature: GYAE6OF02G4ZH7.51.3.A03.1.454.CMB.1.raw
  modified_base (623)..(623): a, c, t, g, unknown or other
  misc_feature (623)..(623): n is a, c, g, or t
tcagcgatcgtatacacgaccggtgctcgatttagagagcgtcacagggggtgggtccgagggaggcagaacttctgggtgtctcaccagtggcctggatccctctacgttcgttccccctcctcacctctctagccgacaggtcttctgaggccctcctatcgagctgacacaggacctaacccgtcggtgtcgtgttcgttcctacaggacacggacggccaggtactctaccttgctctgggtagatgtaccaatttcgaccgaaaagggcaaattagtgtcttaacctggtaaccttacgacaagaagaccgtaggaccgtaacggcccgtccgtagtttcggtttaagtttaaattaagaacttttggagaacggtccctcaagggtacccgtcgagtaccggaattacgttcgtcgtaccgtaaccaagtacgttacgaacgtacgtaaacctaaaccgaaggggttacaccggtttacggaaaccaacttaaccggtaacgtaaggggtacttaacccgtaaagggtaccgtaaagggtaaacgggtccggtaaagggtcctttcggtaaacttaaccttttaagtttaagccttaagtcggtaaactacggtaanaaacgtcgacgtttacgtttaggtacctaacgtttacttacggtacggttacttttccggggaacgggtaccgggaaactaaacgttccctaacccggtacccttaaggtacccgaccgacccggtaaccgggcttccggtaccccgttaaccccgg

SEQ ID NO: 200392 - DNA, 137 bp, Homo sapiens
  misc_feature: GYAE6OF02GBZ6I.51.3.A03.1.454.CMB.1.raw
  modified_base (126)..(137): a, c, t, g, unknown or other
  misc_feature (126)..(137): n is a, c, g, or t
tcagcgatcgtatacacgaccggtgctcgatttagagagcgtcacagggggcgacagcggccctgggctgcctggtcaaggactacttcctcgtagcactctgagcgggctggcaaggcgcatagnnnnnnnnnnnn

SEQ ID NO: 200393 - DNA, 486 bp, Homo sapiens
  misc_feature: GYAE6OF02F7KI5.51.3.A03.1.454.CMB.1.raw
tcagcgatcgtatacacgaccggtgctcgatttagagagcgtcacagggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagactttgagaggccctcagggacccctgagcgattctctggctccagctcagcgacaacagtcacgttgaccatcagtggagtccaggcagaggacgaggctgactattactgtcagtcatcagacagcagtgcacttatgtctatcggcggaggaccaacgtcgaccgtctaggtcacgcccgaggctcccgg

SEQ ID NO: 200394 - DNA, 560 bp, Homo sapiens
  misc_feature: GYAE6OF02H10PQ.51.3.A03.1.454.CMB.1.raw
  modified_base (394)..(394): a, c, t, g, unknown or other
  misc_feature (394)..(394): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactggtaccagcagaagccaggccaggcccctgtcttggttatttataaagtactttgagacggccctcgacgggacccctgacgctattctctggcctccagctcagcgacaacagtcacgttgaccatcagtggagtccaggcagaggacgngctgacttattangtcagtcatnagacagcaggtcgactactttagtcgttacgttacgttccggggacgggtacgggtaacccaaacgttcggtaacccgttacccgtagggttaccgaaccggtaccccgaacgggtcccgttcccggacccccgttacccggg

SEQ ID NO: 200395 - DNA, 524 bp, Homo sapiens
  misc_feature: GYAE6OF02ISWNW.51.3.A03.1.454.CMB.1.raw
  modified_base (372)..(372): a, c, t, g, unknown or other
  misc_feature (372)..(372): n is a, c, g, or t
tcagcgatcgtatacacgaccggtgctcgatttagagagcgtcacagggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaaagcaatatgcttactggtaccagcagaagccaggccaggcccctgtctttggttatttataaagtactttgagtacggccctcgacgggacccctgagcgattctcgtcggctccagctcagcgaacaacagtcacgttnaccatcgagtggacgtcgaggcaggacggacgaggctagacttattacgtgtcagtcatcagacagcagtggactattagtgtcgtagttcgggcggaacggacctaacgtcgaccgttccgtaggtccgacgacccgtacggcctacccgg

SEQ ID NO: 200396 - DNA, 527 bp, Homo sapiens
  misc_feature: GYAE6OF02G9HA7.51.3.A03.1.454.CMB.1.raw
  modified_base (414)..(414): a, c, t, g, unknown or other
  misc_feature (414)..(414): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttattggtaccagcagaagccggcaggcccctgtgttggtgatgtataaagacactgagaggccctcagggatccctgagcgattctctggctccaggtcagggacaacggtcacattcggcatcagtggagtccagggcagaggacgaggctagacttattattgtacaatccaanagaacacctattggtactttattggtacttcgggaactggacgacctaacggtcctaaccggtcctagggtacctacggcccgaaggccccaaccccacgttcgtactacccg

SEQ ID NO: 200397 - DNA, 538 bp, Homo sapiens
  misc_feature: GYAE6OF02HAVT1.51.3.A03.1.454.CMB.1.raw
tcagcgatcgtatacacgaccggtgctcgatttagagagcgtcacagggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagtcaatatgcttactggtaccagcagaagccaggccaggcccctgtcttggttattataagtactttgagaggccctcgagggacccctgacgcgattctctggctccagtctcagcgaacaacagtacacgttcgaccatcagtgactccaggcagaggacgaggctagacttatactgtacagtcatacagacgagcgagtcggactacgttagtgttacgttagttcgggacggtaacgggaacctaaacgtcggtacccgtaccgtacggtccgaaccggtacccgtaacggtcctaccccgg

SEQ ID NO: 200398 - DNA, 715 bp, Homo sapiens
  misc_feature: GYAE6OF02H9S3O.51.3.A03.1.454.CMB.1.raw
  modified_base (173)..(173): a, c, t, g, unknown or other
  misc_feature (173)..(173): n is a, c, g, or t
  modified_base (183)..(183): a, c, t, g, unknown or other
  misc_feature (183)..(183): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
tcagcgatcgtatacacgaccggtgctcgatttagagagcgtcacagggggtgggtccgaggaggcagaactctgggtgtctcaccatggcctggatccctctacttcctccccctctcactctctgcacaggctctgaggcctctatgagctgacacagcccaccctcggtntctgtgtccnaggacaggacggccaaggattcacctgctcgnggantgctattgaccaaaagcaaatntgcttacnggtaccagcaagaagccaggcctaggcccctgtccttaggttatttaataaagtactttaggagaacggtcccctagacgggaccctggacgcgtattctctcggcttccgaagtcctacacggaccgaaacaaaccgagtttaccaacggtttaccgaaccctaattacccgaggtacggtacgtaccgacggacgaaggagggaaccggttacgggactacggtaacgttaacgttttacgacgttaccgtaaacggttacaacgttacgaacggtaacgaacgacccgtaaaggtccggtaacctaaccggttttaataccgggtttacgtttaacggttccggggtacgggtaacgggaaaccccttaaaacggtcggtaaaccccgttacccggttagggtacccgtaaccggaaccccgtaaacggggccttcccccgggtaccccccggttaacccggg

SEQ ID NO: 200399 - DNA, 558 bp, Homo sapiens
  misc_feature: GYAE6OF02F327Z.51.3.A03.1.454.CMB.1.raw
  modified_base (264)..(264): a, c, t, g, unknown or other
  misc_feature (264)..(264): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtgtcctcagggacaggaccggccaggatcacctgctctggagatgcattgaccaaaagcaatatgtcttactggtaccagcagaacnccagccacggcccctgtcttggttatttataaagtctttgagacggtccctcgacgggacccctgagcgtattctctggcctccagcctcgagcgaacaacagtcacgttgaccatcgagtggacgtcaggacaggagacgaggctagacttattactgtcagtcatcagacagcaggtcgactaacttacgtcgttacgtagttccgggacggtaacgggaacccaaaccgttcggtaacccgttaccttagggtccacggacccgaagggcccttaccgcccccgtaccggg

SEQ ID NO: 200400 - DNA, 656 bp, Homo sapiens
  misc_feature: GYAE6OF02HVXHI.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcgatgtctgtgtcctcaggacagacggcaggatcacctgctctggagatgctattgaccaaaagcaatatgtcttactacggtaaccagacaagaacgccgacggccgaacggccccttgtcgtttaggtttaattttaagttaaaagtaccgttttggaacgtacggcccttacgacgggacccctgacgtcgattctacgtcggctacacgcctcgagaccgacaacgtacgtacgtacgttacgacctagtcaggtggacgtccgaggacagggacgacggaggcgtagtacttaattacgtgtacgacgtactagttacaagaccgagtacgacggtggtaacctagtttaacgttagttccggtttaggttccggggaccggggtaacgggaaaccctaaaacggtccggtaaaccccggtttccgtaacgggttaccgaaccggtaccccggtaaacggtcccggttacccgtacccccccgg

SEQ ID NO: 200401 - DNA, 633 bp, Homo sapiens
  misc_feature: GYAE6OF02H27BL.51.3.A03.1.454.CMB.1.raw
  modified_base (185)..(185): a, c, t, g, unknown or other
  misc_feature (185)..(185): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtcgtcctnaggacagacggccaggatcacctgctctggagatgctattcgaccaaaagctaattatcgtacttacgtcggtaccagacaagaacgccgaggccacggccctgtcttggtttattaactaagtacttagagacggccctacggacggacccctggacgcgtacttcgtacgtcgccgtcacgtcctacgacgacgaacaacgtagtaccgtacgttacgacctacgtcgaggtaggacgtaccgagggacgaggaacggacggaggtccgtacgtaacttaacgtttcgtagtacgtacgtacacgtaccgaagacacgcgtaggtacgtaccgttagtcgttacggttacgtacggttacgggacggtaacgggaacctaacggtccgtaacccggtccgttaacggccgaacggcccgaacggtccgtccccgtcccgttaccgg

SEQ ID NO: 200402 - DNA, 588 bp, Homo sapiens
  misc_feature: GYAE6OF02JI051.51.3.A03.1.454.CMB.1.raw
tcagcgatcgtatacacgaccggtgctcgatttagagagcgtcacagggggctgtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccaggatcacctgctctggagatgcattcgaccaaagcaatatgcttactgtaccagtcagagccaggccacggccctgtcttggttattataagtactttgagacgccctacgacggacccctgagcgtattctctggctccgagctcgagtcgaacaacgagtaccgtacgtttacgaaccattaccgagtacggacgtccgaggtacaacgggtacggacgtaggcctaaggtaccttagttaccgtgttcgaacggtcaagtcgaagtacgagacgtagtacggactaacgttagttcgttaccgttacgtttacgggaccggtaacggtaccgaaaccgtcggtacccgtacggtacggtaccgacgtaccccgaggtccctcccgg

SEQ ID NO: 200403 - DNA, 774 bp, Homo sapiens
  misc_feature: GYAE6OF02IV0SJ.51.3.A03.1.454.CMB.1.raw
tcagcgatcgtatacacgaccggtgctcgatttagagagcgtcacagggggctgtgggtccaggaggcagaactctgggtgtctcaccatggcctggatccctctacttctcccctcctcactctctgcacaggctctgaggcctcctatgagctgacacagccaccctcggtgtctgtgtcctcgaggacaggacggccaggactcacctgctcgtggagatgcattgaccaaaagccaaatatcgtaccttacgtcgggtaaccaggacaaggaaacggcccgaaggacccgaacgggtcccccttggttaccgtttagggtttaattttaaactaaaaggtaccttttaggaaacggtacgggaccccttacggaaccgggtaccccttaggaacggtaccgttaactttcgtccgtacgggtaccttccgaacggtccctacggacgaccggtaaacaacgtacgtaccgtaacgtttacgaccctaagtacctaaggtagggacgtaccgacggacaacgggaacggaccggtaacgggctttaacggaaccgtttaaactttaccgtacgttaccgtaaggttaccgtaaacttaccggaaacgtaaccctaaggtaccgtaacgggtttccaccgttaactttaaggtccgttacggttaaggttacccgggtaacggggtaaccggaaaccgtaaacggttccggtaacccggtaccggtttaacggtccgtaaacgaccccggttaacggtcccgtacccccggg

SEQ ID NO: 200404 - DNA, 535 bp, Homo sapiens
  misc_feature: GYAE6OF02GCVHA.51.3.A03.1.454.CMB.1.raw
  modified_base (352)..(352): a, c, t, g, unknown or other
  misc_feature (352)..(352): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggccccctgtcttggttatttataaagactttgagaggccctcgacgggacccctgagcgattctctggctccagctcagcgacaacngtcacgttgaccatcgagtggacgtccgaggcaggaggacgaggctgacttatactgtacagtcatcagacagacaggtgctacttagtgttacgtagttcgggcggtacgggaaccctaacgtacggtacccgttccgtaggtaccacggtaccccgaaggcccttccgcccccgttaccgg

SEQ ID NO: 200405 - DNA, 598 bp, Homo sapiens
  misc_feature: GYAE6OF02FVDJH.51.3.A03.1.454.CMB.1.raw
  modified_base (238)..(238): a, c, t, g, unknown or other
  misc_feature (238)..(238): n is a, c, g, or t
tcagcgatcgtatacacgaccggtgctcgatttagagagcgtcacagggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgcctctggagatgcattgacccaaaccgntatgcttattggtaccagcagaagccggccaggcccctgtgttggtgatgtataaagacatgagacggccctcgaggactcccgtgagcgtattctctggctccgaggtcgagggacaacggtcactagttcgcatcgagtggagtccgaggcaaggaggacgaggctagacttattattgtactaatcaaacagaccaccgtagtttacgggttaactttagttacgttaccgtttaccgggtaacttcgggacccgaaccggtaaacgggtccctaaccccgggttcccgttacggggttacccaccggtaccccgaaaccgggtacccccaaacccccgtacgttacgttaaccccg

SEQ ID NO: 200406 - DNA, 741 bp, Homo sapiens
  misc_feature: GYAE6OF02JBN4S.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgaccaaagcaatatgcttactcggtaccagcaagaagccaggccacggcccctgtcttggtttaattataaagtactttagagacggccctcgacgggtacccctgacgcgtacttctcgtcggtcctccagcctacacgacgaactaaacgtacgtaccaaccggtttacgaaccctagttacgtaacggtacgggaacggttcccgaaggggcctaaaggggaacgggtaaaccggaagggtccgttaacggtaaccgtttaacgttttaccgtacggttaccgtaacgttcctaacgttaccgaacggtaaccgtaacggtacgtaacggtacggtaccttaacgtttaacgtcggtttaccggtttaacggttccgggggtaacgggaaccggggtaaacccgtaaaaccggttacccgggtaaccccggtttaacccggttaaccgggttacccgaaccgggtaaccccggtaaccgggttccccgtacccgggtccccccggtttaacccggg

SEQ ID NO: 200407 - DNA, 646 bp, Homo sapiens
  misc_feature: GYAE6OF02GBN0B.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtctgtgtcctcaggacagacggccaggatcacctgctcgtggagatgcattcgaccaaagcaatatgcttatggtaccagcaagaacggccggccacggcccgtgtggttggtgagtgtaataagacacgtgagacggcctacgagggactcccgagacgcgtacttctcgtggcctcgaggtcgaagggactaacggtacactagttcggacctagtcgtaaggtcggacgtcccggagggtaccgaagggtaacgggaacggacggtccgttaggtaacttagtttagttcgtaactaaacttaccgaaacctacgaacctaaccgttagttacggttaactttataccgttacgttacggaacgtcggtaccgaaccgttagggtacccgtaccggttccggtacgggtaccaacggtaccccgtaaccgggtaaccccctaacccgtacgttacccgtccgttaacccg

SEQ ID NO: 200408 - DNA, 598 bp, Homo sapiens
  misc_feature: GYAE6OF02IQMDL.51.3.A03.1.454.CMB.1.raw
  modified_base (240)..(240): a, c, t, g, unknown or other
  misc_feature (240)..(240): n is a, c, g, or t
  modified_base (376)..(376): a, c, t, g, unknown or other
  misc_feature (376)..(376): n is a, c, g, or t
  modified_base (466)..(466): a, c, t, g, unknown or other
  misc_feature (466)..(466): n is a, c, g, or t
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatccacctgctctgggagatgctattcgacccaaagcaatntgcttactggtaccagcaagaagccgaggccacggcccctgttcgtttggtttaatttataaaagtacgtttggaggacggcccctcgacgggacccctggagcgattctcgtggcctcagcctcacgcgaacaanagtcacgttcgaccatcaggtggaacgtccgagcaagagggaacggaggctagacttattacgtcgttacgacgttacaagtcaagacgngtaccgaggtcgaccttagttacttcggttgttaggttccgggacggaaccgggtaactaaacgtccggtaaccgtaccgtacggtacgacccggtacccgaacggtcccggttccccgtccccgtacccgg

SEQ ID NO: 200409 - DNA, 541 bp, Homo sapiens
  misc_feature: GYAE6OF02HDZSX.51.3.A03.1.454.CMB.1.raw
  modified_base (437)..(437): a, c, t, g, unknown or other
  misc_feature (437)..(437): n is a, c, g, or t
tcagcgatcgtatacacgaccggtgctcgatttagagagcgtcacagggggtgggtccaggaggcagaactctgggtgtctcaccatggcctggatccctctacttctccccctctcactctctgcacaggctctgaggcctcctatgagctgacacagccaccctcggtgtctgtgtcctcaggacagacggccaggatccacctgctctggagatgctattcgaccaaagcaatatgcttactggtaccagcagaagccaggccacggcccctgtctttggttatttataaagtactttgagacggccctcgacgggacccctgacgcgtattctctggctccagcctacacgacgaacaacgagtctacgttcgaccatcgaggtgacgtccgagggcaggacggacgacggctagtaacttattacgtgtacngtcagtcagacagcgaggtcgcctattagtcgttacgttagtcgggacggacgggaaccaacgtcgaaccgttcgtagtcacgcccgaaggcctccgcccctcg

SEQ ID NO: 200410 - DNA, 629 bp, Homo sapiens
  misc_feature: GYAE6OF02JKREZ.51.3.A03.1.454.CMB.1.raw
  modified_base (385)..(385): a, c, t, g, unknown or other
  misc_feature (385)..(385): n is a, c, g, or t
  modified_base (421)..(421): a, c, t, g, unknown or other
  misc_feature (421)..(421): n is a, c, g, or t
  modified_base (521)..(521): a, c, t, g, unknown or other
  misc_feature (521)..(521): n is a, c, g, or t
tcagcgatcgtatacacgaccggtgctcgatttagagagcgtcacgagggggctggtggtccaggaggcagaactctgggtgtctcaccatggcctggagtccctctacgttctcccctcctcactctctgcacgaggctcgtgaggccctcctatggacgctgacacacgccaccctcggtgtcctggtcgtcctcgaggacagacggccaggactccaccgtgctcgtggacatcgactattcgaccaagctaatactgtcgttacgtcggtaccgacgcgagaacgccgacggccacgccccgtagtcgttgtttacttaataagtactttgacgacggtccgtacgacgggtacccctgacgtcgtacttccgtcgtctcncgtacgtcacgtacgacgacacgtcgactcgctacncgtacgaggtcgcgtacgacgacgtacgaacgacggtagcgttaacgtacgttaacgtgtacgtacgtacgtacgtagaccgtagacgtacgacgtacgntacgtaattcgtaggtacgtacggtacgggaacgggtaaccgaacgttacggaccgttaccggtacggtacgtaacccgtaaccgacggtaccggtccgtaaccccgg

SEQ ID NO: 200411 - DNA, 692 bp, Homo sapiens
  misc_feature: GYAE6OF02ISR5S.51.3.A03.1.454.CMB.1.raw
tcagcgatcgtatacacgaccggtgctcgatttagagagcgtcacagggggctgtgggtccaggaggcagaactctgggtgtctcaccatggcctggatccctctacttctccccctcctcactctctgcacaggctctgaggcctcctatgagctgacacagcccacccgtggtgtcttgtgtccctcgaggacgagaccggcgaggactaccgtactcgcttcggtaggaacgtgtcgtacttacggtaccgaaaccgaaaacgtactaaattacgtcgttaaccttacggtaccggaaccagacgaagaccgaccgaacggacccgtaccggtcccgttaggttggtttggaactagtaacggttaaacgtaaaggacctagtacggacggaccggtccctagggacggtacctcgacgtcgtacgtcttctcggtcgcgtacgtagacggacgaacgtacgctacgtgtacgcgtatacggagttacggctaccgggagaggaacgggcgaagggtccgtagtactaacgtttaacgttacgtagttaaccaagtaaccgaaaccgtaaacgaccttaccggtttagttaccggttaactagttcccgtttgacggttaacgcgaccgtaacggtctccggtaccgtgggtaaccgtcgacccgaaccggtaccgacccctacgtacg

SEQ ID NO: 200412 - DNA, 660 bp, Homo sapiens
  misc_feature: GYAE6OF02FVWP9.51.3.A03.1.454.CMB.1.raw
  modified_base (170)..(170): a, c, t, g, unknown or other
  misc_feature (170)..(170): n is a, c, g, or t
  modified_base (213)..(213): a, c, t, g, unknown or other
  misc_feature (213)..(213): n is a, c, g, or t
  modified_base (364)..(364): a, c, t, g, unknown or other
  misc_feature (364)..(364): n is a, c, g, or t
tcagcgatcgtatacacgaccggtgctcgatttagagagcgtcacagggggtgggtccaggaggcagaactctgggtgtctcaccatggcctggatccctctacttctccccctctcactctctgcacaggctctgaggcctcctatgagctgacacagccaccctcggngtctgtgtcctcaggacagacggccaggatcactgctctgganatgcagttcgaccaaagcaaatatcgacttactcggtaccagctaaggaacgccgaggccacggccccttgtctttaggttatttaataaagtactttgagtacggcctcgacgggcccctggacgtcgtacttcgtcgtcggtctccganctcgacgcgaacaactagtcctaacgttcgacctatacgaggttacggacgtcgaggacgaggacggacggaggtcctagtaacgttacgttactcgtacgtactcgtaactcgaacgtaccgagtaccgtacggttcggtaccgttaacgtttacggtacggttcgggttaacgttccggggaaccggggtaaccggaaaccgtaaaccggtaccggtaacccggttacccgttaaggtccccgaaccggtaccccggtaacgggtcccgttaccccggtcccccgttaccccgg

SEQ ID NO: 200413 - DNA, 755 bp, Homo sapiens
  misc_feature: GYAE6OF02FK8KT.51.3.A03.1.454.CMB.1.raw
  modified_base (172)..(172): a, c, t, g, unknown or other
  misc_feature (172)..(172): n is a, c, g, or t
tcagcgatcgtatacacgaccggtgctcgatttagagagcgtcacagggggtgggtccaggaggcagaactctgggtgtctcaccaatggcctggatccctctacttctccccctcctcactctctgcacaggctctgaggcctcctatgagctgacacagccaccctggtntctgtgtcctgaggacagaccggccaggatcacctgcctctggagatgctattgaccaaagccaaatatcgtacttacgtaggtaccagacaagtaacgccgaggccacggcccctgttcgttaggtttaatttaagtaaagtacgtttagaacggacggaccctcgaacgggtacccctaggacgtcgtacttcgtcgtcggtcctccgagtcctacgtaacggacgaacctaacgtacgttaccgtaacggttacgtaaccctaagtacgtaacgggtacgggtacgtacccggagggaccgtaacgggaacgggtaaccggacgggtacgttacggtaacgttaacgtttaaccgttacggtacctaacggtactacgtaaccgaacggaaccgtacgtaaccgtagggttaccggtaccgttaacgtttaacggtaccgtttacgtttaaccggttaccgggaccgggtaaacgggttaaacccaaaccggttcccgggtaacccggttacccgttacggtaacccgtaccggtaaccccggtaaggtacccgttaccccggtacccccggttacccgg

SEQ ID NO: 200414 - DNA, 752 bp, Homo sapiens
  misc_feature: GYAE6OF02JGP25.51.3.A03.1.454.CMB.1.raw
  modified_base (702)..(702): a, c, t, g, unknown or other
  misc_feature (702)..(702): n is a, c, g, or t
tcagcgatcgtatacacgaccggtgctcgatttagagagcgtcacagggggtgggtccaggaggcagaactctgggtgtctcaccatggcctggatccctctacttcctccccctcctcactctctgcacaggctctgaggcctctatgacgctgacacagcccacccgtcggtgtctggtcgtccctcgacggtacacggccggaccaggactccaccttgctccgtagggagtagtggtactacgttcggaacccaaaaggacctaattacgttcggtacttaccgtacggtaccacgtacgaacgacgccggacggaccgtacggtccccgttagtccgttttagttaacttaataacggtatttggacgtaccggcctacgaccgggtaccctagacgtcgtacttcgtacgtacggtcctacgacgtcgtacgtacggaaccgactaacgtaacgtacccgtaacggttaccggaacctacggtaccgtagggtaccggtacgtacccggaaggccggaaagggtaccggaacgggtaggtaccggtacgtaacgttacgtttaacggtacgtacgtacgtacgtacttacgaacggtaacagtaccggtacggtacgtacgttcgtttactgggttaccgttaggtacccgggagggtaaccggtaacccgttaaggccgtaaccggttacccggnggttaacgacccggtaggtacccggtaccgtcccggtacccggttaccgg

SEQ ID NO: 200415 - DNA, 631 bp, Homo sapiens
  misc_feature: GYAE6OF02HP25H.51.3.A03.1.454.CMB.1.raw
  modified_base (104)..(104): a, c, t, g, unknown or other
  misc_feature (104)..(104): n is a, c, g, or t
  modified_base (175)..(175): a, c, t, g, unknown or other
  misc_feature (175)..(175): n is a, c, g, or t
  modified_base (221)..(221): a, c, t, g, unknown or other
  misc_feature (221)..(221): n is a, c, g, or t
tcagcgatcgtatacacgaccggtgctcgatttagagagcgtcacagggggctgtgggtccaggaggcagaactctgggtgtctcaccatggcctggatccctntacttctccccctcctcactctctgcacaggctctgaggcctcctatgagctgacacagcccaccctggtntctgtgtcctcgaggagagaccggccaggatcacctgctcgtgganatgacagttgaccaaagcaaatatgcttactaggtaccagcaagaacgccaggccacggccctgtcttggtttattataaagtctttgagacgccctacgacggacccctgacgcgtattctcgtcggtcctccgacgtctacgacgcgaaccaacgacgtacgtacgtttcgaaccatccgtaggttagggacgtaccgacggagtaacggagggaacggaggtaccgtagtaacttacgtttaccgtcgtactacggtactacgttacgacgacgacgtcgaggtaccggactaacgtttagtcggttacgtttacggtaccgggacgggtaaccggaaccctaaacggtccggtaacccgttaccgtacggtcccgaaccggacccgtaaccggtcctacccccggg

SEQ ID NO: 200416 - DNA, 659 bp, Homo sapiens
  misc_feature: GYAE6OF02H43VP.51.3.A03.1.454.CMB.1.raw
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
tcagcgatcgtatacacgaccggtgctcgatttagagagcgtcacagggggtgggtccaggaggcagaactctgggtgtctcaccatggcctggatccctctacttctccccctctcactctctgcacaggctctgaggcctctatgagctgacacagcccaccctcggtgtctgtcgtcctcaggacagacggccaggatccacgtgctcgtgganatgctaattcgaccaaagcaatntacgtacttacgtaggtaccaagacaagaacgtccgaggaccgacggtcccctagttccgttaggttttaactttaagtaaaagtctttacgaaggtacgtcccgtacgaacgggtacccctagacgacgtacttcgtcgtcggtaccctacgacgtctacgacgacgaaacactacgtacgtacgttacgaacctaagtcgtaagttcggacgtaccgaagcgaagacggacgtagtactagtaaccttagtttacgtagtacgtagtacacttagacgaagacgtacgtaggacgttactaacgttagtaacgttcgttacggttaccggaacgggaacgtaaacccgtaacgtccggtaaccgtacggtacgacctaacgggacctaacggtccctacccggtcccgttaacccgg

SEQ ID NO: 200417 - DNA, 726 bp, Homo sapiens
  misc_feature: GYAE6OF02JEO43.51.3.A03.1.454.CMB.1.raw
  modified_base (131)..(131): a, c, t, g, unknown or other
  misc_feature (131)..(131): n is a, c, g, or t
  modified_base (187)..(187): a, c, t, g, unknown or other
  misc_feature (187)..(187): n is a, c, g, or t
tcagcgatcgtatacacgaccggtgctcgatttagagagcgtcacagggggtgggtccaggaggcagaactcgtgggtgtctcaccatggcctggatccctctacttctccccctctcactctctgcacgnggctctgaggcctctatgagctgacacacgcctaccctggtgtctggttcgtcctnagggacacggaccggcaggctcaccgtggcctctgggactatgcctagttgaacccgaaaagctaaagtacttcgtcgttaactcggtacacgacgaacgaacgaccgacggtaccgaaccggtccccgttacgttcgtttaggtttaactttaaagtaaacggtacttttggaacggtcggacccgtacggtaccgggaccccttagacggttaacgtacgttcgttccgtacggtcctaccggtacgtcgtaccgtaagaccggtaactaaaccgtaacggttaccgtaaccgtttaccggaacctattaccggtaaggtacgggtacgtacgacgggactaggggacggacggtacgggacttcgtaaccttagtacgttagacctagtcgttaacgactacggtacgtaacggataggtcggactttaacgtatttacggtacgttaggtcgggacggaccgggaacttaacgaggtccccgtaacggttccgtacggacctaccggtacgtaccggtcccgtaacccgttccgg

SEQ ID NO: 200418 - DNA, 772 bp, Homo sapiens
  misc_feature: GYAE6OF02F7RXY.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctctcactctctgcacaggctctgaggcctcctatgagctgacacagccaccctggtgtctgtgtcctcaggacaggacggccaggactcacctgctctggagatgctattgaccaaagcaatatcgacttactcggtaccagacagaacgccgaacggccgaacggtcccccttgtttccgtttacggtttaattttaacgttaaaacgtacgttttaggaacggaacgggtccccttaccggaaccgggtaccccgtaggacgacgtacttccgtcgtcggtcctccgacgcctacgtagaccgaaaccaacacgttaccgtacgtttacgaaccctaagtaccgacggttaggacgtaccggaaggtaccggtaaggaagggaaccggtaacggtccgttacgtaactttaacgtttacgttacgttaccgtaacgtacacgttacgaacgttaacctaacgtaccgtaaggtttacggtttaaaccgtttacggttcgtttaaccgggttaacccggtaacgggtaccgggtaaccgttaaccgggttaacccggtaacccggtttacccgttacgggtaaccctaaccgggtaacccccgtaaaccggtaaccccccgttaaccccgaacgtttacccggtaacccgttaccccg

SEQ ID NO: 200419 - DNA, 888 bp, Homo sapiens
  misc_feature: GYAE6OF02HK76U.51.3.A03.1.454.CMB.1.raw
  modified_base (173)..(173): a, c, t, g, unknown or other
  misc_feature (173)..(173): n is a, c, g, or t
tcagcgatcgtatacacgaccggtgctcgatttagagagcgtcacagggggtgggtccaggaggcagaactctgggtgtctcaccatggcctggatccctctacttcctccccctcctcactctctgcacaggctctgagcctcctatgagctgacacacgcccacctcggtntctgtcgttcctcgaggacacggaccggcctaaggctacgacccttgccttacgtggaagtctagtactagttccgaaccgaaaagacttaaagttacgttacggttaccttaccgttcggttaaccaggtacgaaggaaccgacccgaacggacccgaccggtccccgttggtttaccgtttacgggttttaaacttttaaacgtaaaacggtttacttaacggtaacggtaccggtacccccgtacggtaacccgggtaaccccctagggtaacggtccttaacgttccttaaccggtcggtaccctacccggtacgtaccgttacccgacgaaccgaaccgtaaacgtacggtaccgttaaccggtacgtacccgtaacgttacgtaacggtcgggtaacgaccccggttaggaccggaggaaacgggaccgggacgttacggtacgttaaccgtttaacgtttccgtacgttaaccgttacgttaaccaaccgttacggtaaccggtaaaccgtacgtacccgggtagtttacccgggaattaacggttttaccgaacggttttaccgttaacgggtttacccgggtaacggggtaacccgggtaaaacccgttaaaccggtccgggttaaacccgtttacccggttaaccgggttaccaaccggggtaaccccgtaacggttcccgttacccccggtaccccgttccggg

SEQ ID NO: 200420 - DNA, 756 bp, Homo sapiens
  misc_feature: GYAE6OF02FML6H.51.3.A03.1.454.CMB.1.raw
tcagcgatcgtatacacgaccggtgctcgatttagagagcgtcacagggggtgggtccaggaggcagaactctgggtgtctcaccatggcctggatccctctacttctccccctcctcactctctgcacaggctctgaggcctcctatgagctgacacagcccaccctcggtgtcctgtcgtcctcgaggacagacggccagggatccacctgcctctggagatgcattcgccaaagcaaattatgtacttacgtcggtaaccgacgacgaagaacgtcccgaacgggccccgtaaccgggccccccgttggttcccgttttaggtttaattttaaacgtaaaaacggttacgttttaggacggaccggttcccctacggaaccggtaccccgtaggacggtaccgtactttccgtccttcgggtaccctccgaacgtcctacgacgaccgaactaacgacgttaccgtacggttacgaacctagtcgtaaggtggtaacgtccgaacggtcgaaggacggacgacggcgtacgacttaagttactgtacgactacgacgttacgaagacgaacggtcgtacggtacggtaccttaacgttaagtttccggttaacgttacggttacccgggtaacgggtaaccgggtaaaaccccgtaaccggttacccggtaacccggttaccggttaaccggttccgaacccgggtacccggtaaaccggtccccggttaccccggtcccccggtttacccgg

SEQ ID NO: 200421 - DNA, 394 bp, Homo sapiens
  misc_feature: GYAE6OF01C3LZU.18.17.B06.1.454.CMB.1.raw
  modified_base (366)..(394): a, c, t, g, unknown or other
  misc_feature (366)..(394): n is a, c, g, or t
tcagtacgagtatgcacgaccggtgctcgatttagtcgatagtgaagggaccggattcgaccatctccagagacaattccaaggaacacggtgtcaatggaaatggaacagcctgagagctcgaggacacggctggtctatttctgtggccgaaggacacgactttggggccgcatgaacttccactttgactattggggccagggagccctggtcaccgtctcctcagcctccaccaagggcccatcggtcttccccctggcgccctgctccaggagcacctcgagagcacagcggcctagggcctagcctggtcaaggactacttcccatactcgtactgacgcgggctggcaaggcgcatagnnnnnnnnnnnnnnnnnnnnnnnnnnnnn

SEQ ID NO: 200422 - DNA, 355 bp, Homo sapiens
  misc_feature: GYAE6OF01BH42Q.18.17.B06.1.454.CMB.1.raw
  modified_base (351)..(355): a, c, t, g, unknown or other
  misc_feature (351)..(355): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtcttcccctggcgccctgctccaggagcacctccgagagcacagcggccctgggctgcctggtcaaggactactcccatactcgtactgagcgggctggcaaggcgcatagnnnnn

SEQ ID NO: 200423 - DNA, 358 bp, Homo sapiens
  misc_feature: GYAE6OF01AJWAK.18.17.B06.1.454.CMB.1.raw
  modified_base (353)..(358): a, c, t, g, unknown or other
  misc_feature (353)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggatgcctggtcaaggctacttcccatactcgtactgagcgggctggcaaggcgcatagnnnnnn

SEQ ID NO: 200424 - DNA, 369 bp, Homo sapiens
  misc_feature: GYAE6OF01EHI9S.18.17.B06.1.454.CMB.1.raw
  modified_base (355)..(369): a, c, t, g, unknown or other
  misc_feature (355)..(369): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgtatttggggccgcatgaacttccactttgactattggggtcagggagccctggtcaccgtctcctcagcctccaccaagggcccatcggtcttcccctggcgccctgctccaggagcacctccgagagcacagcggcccctgggctgcctgggtcaaggctacttcccatactcgtactgagcgggctggcaaggcgcatagnnnnnnnnnnnnnnn

SEQ ID NO: 200425 - DNA, 359 bp, Homo sapiens
  misc_feature: GYAE6OF01ETUIP.18.17.B06.1.454.CMB.1.raw
  modified_base (354)..(359): a, c, t, g, unknown or other
  misc_feature (354)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcttccaccaagggcccatcggtcttccccctggcgccctgctccaggagcacctctgggggcacagcggccctgggctgcctggtcaaggactacttcccatactcgtactgagcgggctggcaaggcgcatagnnnnnn

SEQ ID NO: 200426 - DNA, 358 bp, Homo sapiens
  misc_feature: GYAE6OF01A8EFQ.18.17.B06.1.454.CMB.1.raw
  modified_base (354)..(358): a, c, t, g, unknown or other
  misc_feature (354)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgtactgagcgggctggcaaggcgcatagnnnnn

SEQ ID NO: 200427 - DNA, 355 bp, Homo sapiens
  misc_feature: GYAE6OF01EYP4G.18.17.B06.1.454.CMB.1.raw
  modified_base (352)..(355): a, c, t, g, unknown or other
  misc_feature (352)..(355): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtctcccctggcgccctgctccaggagcacctccgagagcacagcggccctgggctgcctggtcaaggactacttcccatactcgtactgagcgggctggcaaggcgcatagnnnn

SEQ ID NO: 200428 - DNA, 391 bp, Homo sapiens
  misc_feature: GYAE6OF01BD64V.18.17.B06.1.454.CMB.1.raw
  modified_base (381)..(381): a, c, t, g, unknown or other
  misc_feature (381)..(381): n is a, c, g, or t
  modified_base (387)..(391): a, c, t, g, unknown or other
  misc_feature (387)..(391): n is a, c, g, or t
tcagtacgagtatgcacgaccggtgctcgatttagtcgatagtgaagggccgattcaccatctccagggacaattccaggaacacgctgtctctacaaatggacagcctgagaactgacgacacggctgtctattattgtgcgagagactactgggttactgtgattcagggagaatctggccatgccccctcgctagacgccttctctaatcctgactactggggccgggaacccggtcgtcgtctcctctgcctccaccaagggcccatcggtcttcccctggcgccctgctccaggagcacctccgagagcacagcggccctgggctgcctggtcaaggctacttcccatactcgtactgagcgggctgggcaaggcncatagnnnnn

SEQ ID NO: 200429 - DNA, 384 bp, Homo sapiens
  misc_feature: GYAE6OF01D5G7D.18.17.B06.1.454.CMB.1.raw
  modified_base (364)..(364): a, c, t, g, unknown or other
  misc_feature (364)..(364): n is a, c, g, or t
  modified_base (366)..(384): a, c, t, g, unknown or other
  misc_feature (366)..(384): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctaccaccaagggcccatccggtcttccccctggccgccctgctccaggacgcaccctccggagagcacagccggcccctgggctgcctggtcaaggctacttcccatactcgtactgacgcgggctggccaaggcgcagtagncnnnnnnnnnnnnnnnnnnn

SEQ ID NO: 200430 - DNA, 405 bp, Homo sapiens
  misc_feature: GYAE6OF01DKVRI.18.17.B06.1.454.CMB.1.raw
  modified_base (166)..(166): a, c, t, g, unknown or other
  misc_feature (166)..(166): n is a, c, g, or t
  modified_base (353)..(353): a, c, t, g, unknown or other
  misc_feature (353)..(353): n is a, c, g, or t
  modified_base (371)..(405): a, c, t, g, unknown or other
  misc_feature (371)..(405): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcggaaggacacgtatttggggccgnatgaacttccactttgactattggggccagggagccctggtcaccgtctcctcacgcctccaccaagggcccatccggtcttccccctggccgccctgcctccaggagccaacctccgagagcacgagccggcccctggggctggcctgggtcaagggctacttcccatactcgtactgaggcgggntggcaaggcgcaataggnnnnnnnnnnnnnnnnnnnnnnnnnnnnnnnnnnn

SEQ ID NO: 200431 - DNA, 358 bp, Homo sapiens
  misc_feature: GYAE6OF01AMT1V.18.17.B06.1.454.CMB.1.raw
  modified_base (355)..(358): a, c, t, g, unknown or other
  misc_feature (355)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgatagcacagcggcccctgggctgcctggtcaaggactacttcccatactcgtactgagcgggctggcaaggcgcatagnnnn

SEQ ID NO: 200432 - DNA, 344 bp, Homo sapiens
  misc_feature: GYAE6OF01CIT4I.18.17.B06.1.454.CMB.1.raw
  modified_base (339)..(344): a, c, t, g, unknown or other
  misc_feature (339)..(344): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaagagcagtggctgggacatggacgtctggggccaagggaccacggtcaccgtctcctcagcctccaccaagggcccatcggtcttccccctggcgccctgctccaggagcacctccgagagcacagcggccctgggctgcctggtcaaggactacttcccatactcgtactgagcgggctggcaaggcgcatagnnnnnn

SEQ ID NO: 200433 - DNA, 361 bp, Homo sapiens
  misc_feature: GYAE6OF01AZOBA.18.17.B06.1.454.CMB.1.raw
  modified_base (354)..(361): a, c, t, g, unknown or other
  misc_feature (354)..(361): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaagggcccatcggtcttccccctggccgccctgctccaggagcacctccgagagcacagcggccctgggctgcctggtcaaggactactcccatactcgtactgagcgggctggcaaggcgcatagnnnnnnnn

SEQ ID NO: 200434 - DNA, 359 bp, Homo sapiens
  misc_feature: GYAE6OF01CVF4V.18.17.B06.1.454.CMB.1.raw
  modified_base (353)..(359): a, c, t, g, unknown or other
  misc_feature (353)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggacgcacctccgagagcacagcggccctgggctgcctggtcaaggctacttcccatactcgtactgagcgggctggcaaggcgcatagnnnnnnn

SEQ ID NO: 200435 - DNA, 358 bp, Homo sapiens; identical to SEQ ID NO: 200426
  misc_feature: GYAE6OF01EUIBV.18.17.B06.1.454.CMB.1.raw
  modified_base (354)..(358): a, c, t, g, unknown or other
  misc_feature (354)..(358): n is a, c, g, or t

SEQ ID NO: 200436 - DNA, 356 bp, Homo sapiens
  misc_feature: GYAE6OF01B8KS3.18.17.B06.1.454.CMB.1.raw
  modified_base (353)..(356): a, c, t, g, unknown or other
  misc_feature (353)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggactacttcccatactcgtactgagcgggctggcaaggcgcatagnnnn

SEQ ID NO: 200437 - DNA, 367 bp, Homo sapiens
  misc_feature: GYAE6OF01D41HF.18.17.B06.1.454.CMB.1.raw
  modified_base (353)..(367): a, c, t, g, unknown or other
  misc_feature (353)..(367): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtctccccctggcgccctgctccaggacgcacctccgagagcacagcggccctgggctgcctggtcaaggctacttcccatacctcgtactgagcgggctggcaagcgcatagnnnnnnnnnnnnnnn

SEQ ID NO: 200438 - DNA, 370 bp, Homo sapiens
  misc_feature: GYAE6OF01ERC2W.18.17.B06.1.454.CMB.1.raw
  modified_base (354)..(370): a, c, t, g, unknown or other
  misc_feature (354)..(370): n is a, c, g, or t
tcagtacgagtatgcacgaccggtgctcgatttagtcgatagtgaagggccgagttcaccatctccagagacaattccaagaacacggtgtcaatggaaatgaacagcctcgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctactcccatactcgtactgagcgggctggcaaggcgcatagnnnnnnnnnnnnnnnnn

SEQ ID NO: 200439 - DNA, 376 bp, Homo sapiens
  misc_feature: GYAE6OF01C43Q8.18.17.B06.1.454.CMB.1.raw
  modified_base (252)..(252): a, c, t, g, unknown or other
  misc_feature (252)..(252): n is a, c, g, or t
  modified_base (340)..(340): a, c, t, g, unknown or other
  misc_feature (340)..(340): n is a, c, g, or t
  modified_base (365)..(376): a, c, t, g, unknown or other
  misc_feature (365)..(376): n is a, c, g, or t
tcagtacgagtatgcacgaccggtgctcgatttagtcgatagtgaagggccgattcaccatctcccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcacgcctccaccaagggcccatccggtcttccccnggccgccctgctccaggacgccacctccgagacgcacgagccggccctgggcctgcctggtcaaggacctacttcccatactcgtacngagcgggctggcaaggcgcaatagnnnnnnnnnnnn

SEQ ID NO: 200440 - DNA, 359 bp, Homo sapiens
  misc_feature: GYAE6OF01DASY5.18.17.B06.1.454.CMB.1.raw
  modified_base (353)..(359): a, c, t, g, unknown or other
  misc_feature (353)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttgggccgcatgaacttccactttgactattggggccagggagccctggtcaccgtctcctcagcctccaccaagggcccatcggtcttcccctggcgccctgctccaggagcacctccgagagcacagccggccctgggctgcctggtcaaggactaccttcccatactcgtactgagcggctggcaaggcgcatagnnnnnnn

SEQ ID NO: 200441 - DNA, 360 bp, Homo sapiens
  misc_feature: GYAE6OF01BFGON.18.17.B06.1.454.CMB.1.raw
  modified_base (354)..(360): a, c, t, g, unknown or other
  misc_feature (354)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgtactgagcgggctggcaaggcgcatagnnnnnnn

SEQ ID NO: 200442 - DNA, 363 bp, Homo sapiens
  misc_feature: GYAE6OF01CE4GV.18.17.B06.1.454.CMB.1.raw
  modified_base (357)..(363): a, c, t, g, unknown or other
  misc_feature (357)..(363): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctgctccaggacgcacctccgagagcacagccggccctggactgcctggtcaaggactacttcccatactcgtactgagcgggctggcaaggcgcatagnnnnnnn

SEQ ID NO: 200443 - DNA, 356 bp, Homo sapiens
  misc_feature: GYAE6OF01BJ3DX.18.17.B06.1.454.CMB.1.raw
  modified_base (352)..(356): a, c, t, g, unknown or other
  misc_feature (352)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtctccccctggcgccctgctccaggagcacctccgagagcacagcggccctgggctgcctggtcaaggctacttcccatactcgtactgagcgggctggcaaggcgcatagnnnnn

SEQ ID NO: 200444 - DNA, 359 bp, Homo sapiens
  misc_feature: GYAE6OF01EFR0J.18.17.B06.1.454.CMB.1.raw
  modified_base (353)..(359): a, c, t, g, unknown or other
  misc_feature (353)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctacttcccatactcgtactgagcgggctggcaaggcgcatagnnnnnnn

SEQ ID NO: 200445 - DNA, 357 bp, Homo sapiens
  misc_feature: GYAE6OF01CDF8Y.18.17.B06.1.454.CMB.1.raw
  modified_base (354)..(357): a, c, t, g, unknown or other
  misc_feature (354)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgcctgctccaggagcacctccgagagcacagccggccctgggctgcctggtcaaggactacttcccatactcgtactgagcgggctggcaaggcgcatagnnnn

SEQ ID NO: 200446 - DNA, 359 bp, Homo sapiens
  misc_feature: GYAE6OF01ANPDP.18.17.B06.1.454.CMB.1.raw
  modified_base (355)..(359): a, c, t, g, unknown or other
  misc_feature (355)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggccgccctgcctccaggagcacctccgagagcacagcggccctgggctgcctggtcaaggactacttcccatactcgtactgagcgggctggcaaggcgcatagnnnnn

SEQ ID NO: 200447 - DNA, 355 bp, Homo sapiens
  misc_feature: GYAE6OF01BOOZL.18.17.B06.1.454.CMB.1.raw
  modified_base (350)..(355): a, c, t, g, unknown or other
  misc_feature (350)..(355): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacatggctgtctatttctgtgcgaaggacacgatttgggccgcatgaacttccactttgactattgggccagggagccctggtcaccgtctcctcagcctccaccaagggcccatcggtcttcccctggcgccctgctccaggagcacctccgagagcacagcggccctgggctgcctggtcaaggactactcccatactcgtactgagcgggctggcaaggcgcatagnnnnnn

SEQ ID NO: 200448 - DNA, 355 bp, Homo sapiens
  misc_feature: GYAE6OF01CF6LA.18.17.B06.1.454.CMB.1.raw
  modified_base (351)..(355): a, c, t, g, unknown or other
  misc_feature (351)..(355): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgcctgctccaggagcacctccgagagcacagcggccctgggctgcctggtcaaggctacttcccatactcgtactgagcgggctggcaaggcgcatagnnnnn

SEQ ID NO: 200449 - DNA, 358 bp, Homo sapiens
  misc_feature: GYAE6OF01CS3AW.18.17.B06.1.454.CMB.1.raw
  modified_base (352)..(358): a, c, t, g, unknown or other
  misc_feature (352)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcttccaccaaggcccatcggtcttccccctggcgcctgctccaggagcacctctgggggcacagcggccctgggctcgcctggtcaaggactacttcccatactcgtactgagcggctggcaaggcgcatagnnnnnnn

SEQ ID NO: 200450 - DNA, 356 bp, Homo sapiens
  misc_feature: GYAE6OF01BEHMK.18.17.B06.1.454.CMB.1.raw
  modified_base (354)..(356): a, c, t, g, unknown or other
  misc_feature (354)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgtactgagcgggctggcaaggcgcatagnnn

SEQ ID NO: 200451 - DNA, 355 bp, Homo sapiens
  misc_feature: GYAE6OF01DI6DL.18.17.B06.1.454.CMB.1.raw
  modified_base (350)..(355): a, c, t, g, unknown or other
  misc_feature (350)..(355): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgcctgctccaggagcacctccgagagcacagcggcctgggctgcctggtcaaggctactcccatactcgtactgagcgggctggcaaggcgcatagnnnnnn

SEQ ID NO: 200452 - DNA, 359 bp, Homo sapiens
  misc_feature: GYAE6OF01B1Z4U.18.17.B06.1.454.CMB.1.raw
  modified_base (353)..(359): a, c, t, g, unknown or other
  misc_feature (353)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctgctccaggagcacctctgggggcacagcggccctgggctgcctggtcaactacttcccatacctcgtactgagcgggctggcaaggcgcatagnnnnnnn

SEQ ID NO: 200453 - DNA, 372 bp, Homo sapiens
  misc_feature: GYAE6OF01DIIH4.18.17.B06.1.454.CMB.1.raw
  modified_base (163)..(163): a, c, t, g, unknown or other
  misc_feature (163)..(163): n is a, c, g, or t
  modified_base (355)..(355): a, c, t, g, unknown or other
  misc_feature (355)..(355): n is a, c, g, or t
  modified_base (361)..(372): a, c, t, g, unknown or other
  misc_feature (361)..(372): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccncatgaacttccactttgactattggggccagggagccctggtcaccgtcctccgtcacgcctccaccaagggcccatccggtccttccccgtggccgcccctgctccaggacgcacctccgagagcacagcggccctgggctgcctggtcaaggctactcccatcctcgtactgagcgggctggacaaggcncatagnnnnnnnnnnnn

SEQ ID NO: 200454 - DNA, 358 bp, Homo sapiens
  misc_feature: GYAE6OF01CTW4F.18.17.B06.1.454.CMB.1.raw
  modified_base (354)..(358): a, c, t, g, unknown or other
  misc_feature (354)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttccccctggcgccctgctccaggagcacctccgagagcacagcggccctgggctgcctggtcaaggctacttcccatactcgtactgagcgggctggcaaggcgcatagnnnnn

SEQ ID NO: 200455 - DNA, 360 bp, Homo sapiens
  misc_feature: GYAE6OF01AOM3M.18.17.B06.1.454.CMB.1.raw
  modified_base (352)..(360): a, c, t, g, unknown or other
  misc_feature (352)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggctacttcccatactcgtactgagcgggctggcaaggcgcatagnnnnnnnnn

SEQ ID NO: 200456 - DNA, 392 bp, Homo sapiens
  misc_feature: GYAE6OF01BCPMU.18.17.B06.1.454.CMB.1.raw
  modified_base (388)..(392): a, c, t, g, unknown or other
  misc_feature (388)..(392): n is a, c, g, or t
tcagtacgagtatgcacgaccggtgctcgatttagtcgatagtgaagggccgattcaccatctccagagacaattccaagaacacgctgtctctacaaatggacagcctgagaactgacgacacggctgtctattattgtgcgagagactactgggttactgtgattcagggagaatctggccatgccccctcgctagacgccttctctaatcctgactactggggccgggaaccccggtcgtcgtctcctctgcctccaccaagggcccatcggtcttccccctgcgccctgctccaggagcacctccgagagcacagcggccctgggctgcctggtcaaggactacttcccatactcgtactgagcgggctggcaaggcgcatagnnnnn

SEQ ID NO: 200457 - DNA, 359 bp, Homo sapiens
  misc_feature: GYAE6OF01AVTE6.18.17.B06.1.454.CMB.1.raw
  modified_base (353)..(359): a, c, t, g, unknown or other
  misc_feature (353)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctactccaggagcacctccgagagcacagcggccctgggctgcctggtcaaggactactcccatactcgtactgagcggctggcaaggcgcatagnnnnnnn

SEQ ID NO: 200458 - DNA, 360 bp, Homo sapiens
  misc_feature: GYAE6OF01AMD78.18.17.B06.1.454.CMB.1.raw
  modified_base (355)..(360): a, c, t, g, unknown or other
  misc_feature (355)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgcctccaggagcacctccgagagcacagcggccctgggctgcctggtcaaggactacttcccatactcgtactgagcgggctggcaaggcgcatagnnnnnn

SEQ ID NO: 200459 - DNA, 373 bp, Homo sapiens
  misc_feature: GYAE6OF01DYCB7.18.17.B06.1.454.CMB.1.raw
  modified_base (364)..(373): a, c, t, g, unknown or other
  misc_feature (364)..(373): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgcccctgcctccaggacgccacctccgagacgcacagccggcccctgggctgcctggtcaaggacctacttccatactcgtactgagcgggctggcaaggcgcatagnnnnnnnnnn

SEQ ID NO: 200460 - DNA, 366 bp, Homo sapiens
  misc_feature: GYAE6OF01CD46R.18.17.B06.1.454.CMB.1.raw
  modified_base (362)..(366): a, c, t, g, unknown or other
  misc_feature (362)..(366): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtccttccccctggccgccctgcctccaggacgcacctccgagagcacagccggccctgggctgcctggtcaaggactaccttcccatacctcgtactgagcgggctgggcaaggcgcatagnnnnn

SEQ ID NO: 200461 - DNA, 371 bp, Homo sapiens
  misc_feature: GYAE6OF01BPGV9.18.17.B06.1.454.CMB.1.raw
  modified_base (363)..(371): a, c, t, g, unknown or other
  misc_feature (363)..(371): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgccctgctccaggacgccacctccgagagccacagccggccctgggctgcctggtacaaggcctacttcccatactcgtactgagcgggctggcaaggcgcagtagnnnnnnnnn

SEQ ID NO: 200462 - DNA, 362 bp, Homo sapiens
  misc_feature: GYAE6OF01CE8Y8.18.17.B06.1.454.CMB.1.raw
  modified_base (355)..(362): a, c, t, g, unknown or other
  misc_feature (355)..(362): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagccacctccgagacgcacagcggccctgggctgcctggtcaaggactactcccatactcgtactgagcgggctggcaaggcgacatagnnnnnnnn

SEQ ID NO: 200463 - DNA, 385 bp, Homo sapiens
  misc_feature: GYAE6OF01B7FIL.18.17.B06.1.454.CMB.1.raw
  modified_base (361)..(385): a, c, t, g, unknown or other
  misc_feature (361)..(385): n is a, c, g, or t
tcagtacgagtatgcacgaccggtgctcgatttagtcgatagtgaagggccgattcaccatctccagagacaattccaagaacacggtgtcaatggaaatgaacagcctgagagctgagggacacggctgtctatttctgtgcgaaggacacgatttggggccgcatgaacttccactttgactattggggccagggagccctggtcaccgtctcctcagtcctccaccaagggcccaatccggtcttcccctggccgccctgctccaggacgccacctccgagacgcacagcggccctgggctgcctggtcaaggctacttcccgatactcgtaatgagcgggctggcaaggcgcatagnnnnnnnnnnnnnnnnnnnnnnnnn

SEQ ID NO: 200464 - DNA, 362 bp, Homo sapiens
  misc_feature: GYAE6OF01B8FXR.18.17.B06.1.454.CMB.1.raw
  modified_base (357)..(362): a, c, t, g, unknown or other
  misc_feature (357)..(362): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtccttccccctggccgccctgctcccaggacgccacctccgagagcacagcgcccctgggctgcctggtcaaggctactcccatactcgtactgagcgggctggcaaggcgcatagnnnnnn

SEQ ID NO: 200465 - DNA, 395 bp, Homo sapiens
  misc_feature: GYAE6OF01ANBUW.18.17.B06.1.454.CMB.1.raw
  modified_base (383)..(383): a, c, t, g, unknown or other
  misc_feature (383)..(383): n is a, c, g, or t
  modified_base (389)..(395): a, c, t, g, unknown or other
  misc_feature (389)..(395): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctattattgtgcgagagactactgggttactgtgattcagggagaatctggccatgccccctcgctagacgccttctctaatcctgactactggggccgggaacccggtcgtcgtctcctctgcctccaccaagggcccatcggtcttccccctggccgccctgctccaggagcacctccgagacgcacagccggccctgggctgcctggtcaaggctactcccatactcgtactgagcgggctggcaaggcncatagnnnnnnn

SEQ ID NO: 200466 - DNA, 358 bp, Homo sapiens
  misc_feature: GYAE6OF01DPNJB.18.17.B06.1.454.CMB.1.raw
  modified_base (249)..(249): a, c, t, g, unknown or other
  misc_feature (249)..(249): n is a, c, g, or t
  modified_base (353)..(358): a, c, t, g, unknown or other
  misc_feature (353)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccnggccgcctgctccaggacgcacctccgagagcacagcggccctgggctgcctggtcaaggctacttcccatactcgtactgagcgggctggcaaggcgcatagnnnnnn

SEQ ID NO: 200467 - DNA, 358 bp, Homo sapiens
  misc_feature: GYAE6OF01DGFRP.18.17.B06.1.454.CMB.1.raw
  modified_base (352)..(358): a, c, t, g, unknown or other
  misc_feature (352)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgcctgctccaggagcacctccgagagcacagcggccctgggctgcctggtcaaggctacttcccatactcgtactgagcgggctggcaaggcgcatgnnnnnnn

SEQ ID NO: 200468 - DNA, 357 bp, Homo sapiens
  misc_feature: GYAE6OF01EK731.18.17.B06.1.454.CMB.1.raw
  modified_base (353)..(357): a, c, t, g, unknown or other
  misc_feature (353)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggactacttcccatactcgtactgagcgggctggcaaggcgcatagnnnnn

SEQ ID NO: 200469 - DNA, 357 bp, Homo sapiens
  misc_feature: GYAE6OF01EWI30.18.17.B06.1.454.CMB.1.raw
  modified_base (353)..(357): a, c, t, g, unknown or other
  misc_feature (353)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactactcccatactcgtactgagcgggctggcaaggcgcatagnnnnn

SEQ ID NO: 200470 - DNA, 359 bp, Homo sapiens
  misc_feature: GYAE6OF01BZ5K4.18.17.B06.1.454.CMB.1.raw
  modified_base (356)..(359): a, c, t, g, unknown or other
  misc_feature (356)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagccacctccgagagcacagcggccctgggctgcctggtcaaggcctacttcccatacctcgtactgagcgggctggcaaggcgcatagnnnn

SEQ ID NO: 200471 - DNA, 365 bp, Homo sapiens
  misc_feature: GYAE6OF01DHISZ.18.17.B06.1.454.CMB.1.raw
  modified_base (357)..(365): a, c, t, g, unknown or other
  misc_feature (357)..(365): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtccttccccctggccgccctgctccaggagccacctccgagagcacagcggccctgggctgcctggtcaaggactactcccatactcgtactgacgcgggctggcaaggcgcatagnnnnnnnnn

SEQ ID NO: 200472 - DNA, 394 bp, Homo sapiens
  misc_feature: GYAE6OF01B2R3A.18.17.B06.1.454.CMB.1.raw
  modified_base (360)..(394): a, c, t, g, unknown or other
  misc_feature (360)..(394): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccaggggagcccctggtccaccgtctcctcagcctccaccaagggcccatcggtcttcccctggcgccctgctccaggcgcacctccgagagcacagcggccctgggctgcctggtcaaggactacttcccatacctcgtactgacgcgggctggacgaaggcgcatagnnnnnnnnnnnnnnnnnnnnnnnnnnnnnnnnnnn

SEQ ID NO: 200473 - DNA, 489 bp, Homo sapiens
  misc_feature: GYAE6OF01CAZS0.18.17.B06.1.454.CMB.1.raw
  modified_base (165)..(165): a, c, t, g, unknown or other
  misc_feature (165)..(165): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (437)..(441): a, c, t, g, unknown or other
  misc_feature (437)..(441): n is a, c, g, or t
  modified_base (443)..(489): a, c, t, g, unknown or other
  misc_feature (443)..(489): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgtatttgggggccncattgaacttccactttgactagttggggccagggagccctgggtcaccggtctccgtcacgcctccaccgaacgggcccctagtccggtaccttccccccgtggcccgtcccttcggccttccccgagggaccgcctaacccttccggaagacgccaccgacggtcccggccccttggggccctcgggcccgtgggtaccaacggtacctaccttccgataccgtcgtacgtggacgcgggtctggaccgaaggcgacagtagcngcngcnnnnngnnnnnnnnnnnnnnnnnnnnnnnnnnnnnnnnnnnnnnnnnnnnnnn

SEQ ID NO: 200474 - DNA, 360 bp, Homo sapiens
  misc_feature: GYAE6OF01BC7R4.18.17.B06.1.454.CMB.1.raw
  modified_base (352)..(360): a, c, t, g, unknown or other
  misc_feature (352)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggacgcacctccgagagcacagcggccctgggctgcctggtcaaggctactcccatactcgtactgagcgggctggcaaggcgcatagnnnnnnnnn

SEQ ID NO: 200475 - DNA, 390 bp, Homo sapiens
  misc_feature: GYAE6OF01B0355.18.17.B06.1.454.CMB.1.raw
  modified_base (377)..(390): a, c, t, g, unknown or other
  misc_feature (377)..(390): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttccccctggccgccctgctccaggagcacctccgagagacacagccgccgtggctcgccgtggtacgaacggtaccttaccttcccatacctacgtacgtgacggcgggcgtcggacgaacggcgacagtagnnnnnnnnnnnnnn

SEQ ID NO: 200476 - DNA, 365 bp, Homo sapiens
  misc_feature: GYAE6OF01ELUXK.18.17.B06.1.454.CMB.1.raw
  modified_base (348)..(348): a, c, t, g, unknown or other
  misc_feature (348)..(348): n is a, c, g, or t
  modified_base (356)..(365): a, c, t, g, unknown or other
  misc_feature (356)..(365): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctttgcgaaggacacgatttggggccgcatgaacttccactttgactattggggccagggagccctggtcaccgtctcctcagcctccaccaagggcccatcggtctcccctggccgccctgctccaggacgcacctccgagagcacagcggccctgggctgcctggtcaaggactacttcccatactcgtactgagcgggctggcaaggcncgataggnnnnnnnnnn

SEQ ID NO: 200477 - DNA, 361 bp, Homo sapiens
  misc_feature: GYAE6OF01ENN8I.18.17.B06.1.454.CMB.1.raw
  modified_base (347)..(347): a, c, t, g, unknown or other
  misc_feature (347)..(347): n is a, c, g, or t
  modified_base (354)..(361): a, c, t, g, unknown or other
  misc_feature (354)..(361): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtctcccctggccgccctgctccaggacgcacctccgagagcacagccggccctgggctgcctggtcaaggctactcccatactcgtactgagcgggctggcaaggcncatacgnnnnnnnn

SEQ ID NO: 200478 - DNA, 360 bp, Homo sapiens
  misc_feature: GYAE6OF01EHPMZ.18.17.B06.1.454.CMB.1.raw
  modified_base (349)..(349): a, c, t, g, unknown or other
  misc_feature (349)..(349): n is a, c, g, or t
  modified_base (355)..(360): a, c, t, g, unknown or other
  misc_feature (355)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttccccctggcgccctgctccaggagcacctccgagagcacagcggccctgggctgcctggtcaaggactacttcccatactcgtactgagcgggctggcaaggcncatagnnnnnn

SEQ ID NO: 200479 - DNA, 354 bp, Homo sapiens
  misc_feature: GYAE6OF01DJPOZ.18.17.B06.1.454.CMB.1.raw
  modified_base (350)..(354): a, c, t, g, unknown or other
  misc_feature (350)..(354): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctcaccaaggcccatcggtcttccccctggccgcctgctccaggagcacctccgagagcacagcggccctgggctgcctggtcaaggctacttccatactcgtactgagcgggctggcaaggcgcatagnnnnn

SEQ ID NO: 200480 - DNA, 356 bp, Homo sapiens
  misc_feature: GYAE6OF01CYJHW.18.17.B06.1.454.CMB.1.raw
  modified_base (350)..(356): a, c, t, g, unknown or other
  misc_feature (350)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtcttcccctggcgcctgctccaggagcacctccgagagcacagcggccctgggctgcctggtcaaggctacttcccatactcgtactgagcgggctggcaaggcgcatagnnnnnnn

SEQ ID NO: 200481 - DNA, 360 bp, Homo sapiens
  misc_feature: GYAE6OF01DOJUT.18.17.B06.1.454.CMB.1.raw
  modified_base (355)..(360): a, c, t, g, unknown or other
  misc_feature (355)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtccttccccctggccgccctgctccaggagcacctccgagagcacacgcggccctgggctgcctggtcaaggctactcccatactcgtactgacgcgggctggcaggcgcatagnnnnnn

SEQ ID NO: 200482 - DNA, 357 bp, Homo sapiens
  misc_feature: GYAE6OF01EBTUE.18.17.B06.1.454.CMB.1.raw
  modified_base (353)..(357): a, c, t, g, unknown or other
  misc_feature (353)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctacttcccatactcgtactgagcgggctggcaaggcgcatagnnnnn

SEQ ID NO: 200483 - DNA, 364 bp, Homo sapiens
  misc_feature: GYAE6OF01BUKXB.18.17.B06.1.454.CMB.1.raw
  modified_base (357)..(364): a, c, t, g, unknown or other
  misc_feature (357)..(364): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgccctgcctccaggagcacctccgagagcacagcggccctgggctgcctggtcaaggctacttccatactcgtactgacgcgggctggcaaggcgcatagnnnnnnnn

SEQ ID NO: 200484 - DNA, 364 bp, Homo sapiens
  misc_feature: GYAE6OF01EYLJT.18.17.B06.1.454.CMB.1.raw
  modified_base (352)..(352): a, c, t, g, unknown or other
  misc_feature (352)..(352): n is a, c, g, or t
  modified_base (358)..(364): a, c, t, g, unknown or other
  misc_feature (358)..(364): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttcccctggcgccctgcctccaggagcaccctccgagacgcacagccggccctggggctgcctggtcaaggctacttcccatactcgtactgagcgggctggcaaggcncatagnnnnnnn

SEQ ID NO: 200485 - DNA, 362 bp, Homo sapiens
  misc_feature: GYAE6OF01CAUYE.18.17.B06.1.454.CMB.1.raw
  modified_base (253)..(253): a, c, t, g, unknown or other
  misc_feature (253)..(253): n is a, c, g, or t
  modified_base (345)..(345): a, c, t, g, unknown or other
  misc_feature (345)..(345): n is a, c, g, or t
  modified_base (351)..(362): a, c, t, g, unknown or other
  misc_feature (351)..(362): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcncctgctccaggagcacctccgagagcacagcggcctgggctgcctggtcaaggctacttcccatacctcgtactgagcgggctggcaaggcncatagnnnnnnnnnnnn

SEQ ID NO: 200486 - DNA, 356 bp, Homo sapiens
  misc_feature: GYAE6OF01D2H49.18.17.B06.1.454.CMB.1.raw
  modified_base (351)..(356): a, c, t, g, unknown or other
  misc_feature (351)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtccttcccctggcgccctgctccaggagcacctccgagagcacagcggccctgggctgcctggtcaaggctactcccatactcgtactgagcgggctggcaaggcgcatagnnnnnn

SEQ ID NO: 200487 - DNA, 357 bp, Homo sapiens
  misc_feature: GYAE6OF01D6AL2.18.17.B06.1.454.CMB.1.raw
  modified_base (338)..(338): a, c, t, g, unknown or other
  misc_feature (338)..(338): n is a, c, g, or t
  modified_base (353)..(357): a, c, t, g, unknown or other
  misc_feature (353)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttcccctggcgccctgctccaggacgcacctccgagagcacagccggccctgggctgcctggtcaaggctactcccatactcgtactgagcgggntggcaaggcgcatgnnnnn

SEQ ID NO: 200488 - DNA, 382 bp, Homo sapiens
  misc_feature: GYAE6OF01DBU8M.18.17.B06.1.454.CMB.1.raw
  modified_base (281)..(281): a, c, t, g, unknown or other
  misc_feature (281)..(281): n is a, c, g, or t
  modified_base (372)..(382): a, c, t, g, unknown or other
  misc_feature (372)..(382): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagtttggggccgcatgaacttccactttgactagttggggccagggacgccctggtcaccgtctcctcacgcctccaccaagggcccagtccggtccttccccctggcccgccctcgcctccgaggacnccacctccgagacgcacagccggcctgggctgcctggtcaaggactacttcccatactcgtactgacgcgggctggcaaggcgacagtagnnnnnnnnnnn

SEQ ID NO: 200489 - DNA, 358 bp, Homo sapiens
  misc_feature: GYAE6OF01BX5B0.18.17.B06.1.454.CMB.1.raw
  modified_base (354)..(358): a, c, t, g, unknown or other
  misc_feature (354)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggacgcacctccgagagcacagcggccctgggctgcctggtcaaggactacttcccatactcgtactgagcgggctggcaaggcgcatagnnnnn

SEQ ID NO: 200490 - DNA, 372 bp, Homo sapiens
  misc_feature: GYAE6OF01CD8LA.18.17.B06.1.454.CMB.1.raw
  modified_base (359)..(372): a, c, t, g, unknown or other
  misc_feature (359)..(372): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaagggcccatcggtccttccccctggccgccctgctccaggagcacctccgagagcacagccggcctgggctgcctggtcaaggctactcccatactcgtactgacgtcgggctggccaaggcgacagtagnnnnnnnnnnnnnn

SEQ ID NO: 200491 - DNA, 357 bp, Homo sapiens
  misc_feature: GYAE6OF01BSSIT.18.17.B06.1.454.CMB.1.raw
  modified_base (345)..(345): a, c, t, g, unknown or other
  misc_feature (345)..(345): n is a, c, g, or t
  modified_base (350)..(357): a, c, t, g, unknown or other
  misc_feature (350)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttcccctggcgccctgctccaggagcacctccgagagcacagcggccctgggctgcctggtcaaggctactcccatactcgtactgagcgggctggcaggcnatagnnnnnnnn

SEQ ID NO: 200492 - DNA, 489 bp, Homo sapiens
  misc_feature: GYAE6OF01CL45J.18.17.B06.1.454.CMB.1.raw
  modified_base (107)..(107): a, c, t, g, unknown or other
  misc_feature (107)..(107): n is a, c, g, or t
  modified_base (434)..(434): a, c, t, g, unknown or other
  misc_feature (434)..(434): n is a, c, g, or t
  modified_base (476)..(489): a, c, t, g, unknown or other
  misc_feature (476)..(489): n is a, c, g, or t
tcagtacgagtatgcacgaccggtgctcgatttagtcgatagtgaagggccgattcaccatctccagagacaattccaagaacacggtgtcaaatggaaaatgaacncgacctgagagctgaggacgacggcgtgtctatttcttgtgcgaaggaacgacgagtttggggccggcatgtaacttacctcttagtactagttggggccggagggaggccctcggtcgacctccttcctacacgcctccaaccgaaaggggccctactcggttccgtttcccccctcgggacggcccctcgtcgacccgacggaacggccacccgtaccgaggaacggccaacgaacggccgggtccccgtcggggccgtcggtacccgtgggttaccgaaaacgggtaaccttaccctttccctaactaccgttcgtttaaccgngagggccggggtccgtagggaccgaaaggacgcggaataggnnnnnnnnnnnnnn

SEQ ID NO: 200493 - DNA, 361 bp, Homo sapiens
  misc_feature: GYAE6OF01CK7VQ.18.17.B06.1.454.CMB.1.raw
  modified_base (250)..(250): a, c, t, g, unknown or other
  misc_feature (250)..(250): n is a, c, g, or t
  modified_base (355)..(361): a, c, t, g, unknown or other
  misc_feature (355)..(361): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccccnggccgccctgctccaggagcacctccgagagcacagcggccctgggctgcctggtcaaggactacttcccatactcgtactgagcgggctggcaaggcgcatagnnnnnnn

SEQ ID NO: 200494 - DNA, 360 bp, Homo sapiens
  misc_feature: GYAE6OF01DYHR3.18.17.B06.1.454.CMB.1.raw
  modified_base (355)..(360): a, c, t, g, unknown or other
  misc_feature (355)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtctcccctggcgccctgcctccaggagccacctccgagagcacagccggccctgggctgcctggtcaaggactactcccatactcgtactgagcgggctggcaaggcgcatagnnnnnn

SEQ ID NO: 200495 - DNA, 366 bp, Homo sapiens
  misc_feature: GYAE6OF01CWEPD.18.17.B06.1.454.CMB.1.raw
  modified_base (352)..(352): a, c, t, g, unknown or other
  misc_feature (352)..(352): n is a, c, g, or t
  modified_base (358)..(366): a, c, t, g, unknown or other
  misc_feature (358)..(366): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaacgggcccagtccggtcttccccctggccgcctgctccaggacgcacctccgagacgcacagcggccctgggctgcctggtcaaggctacgtccatactcgtactgagcgggctggcgaaggcncatagnnnnnnnnn

SEQ ID NO: 200496 - DNA, 360 bp, Homo sapiens
  misc_feature: GYAE6OF01B8LM6.18.17.B06.1.454.CMB.1.raw
  modified_base (344)..(344): a, c, t, g, unknown or other
  misc_feature (344)..(344): n is a, c, g, or t
  modified_base (350)..(360): a, c, t, g, unknown or other
  misc_feature (350)..(360): n is a, c, g, or t
tcagtacgagtatgcacgaccggtgctcgatttagtcgatagtgaagggccgattcaccatctccagagacaattccaagaacacggtgtcaatggaaatgaaaagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggcctgcctggtcaggctactccatactcgtactgacgcggctggcaaggcncatagnnnnnnnnnnn

SEQ ID NO: 200497 - DNA, 364 bp, Homo sapiens
  misc_feature: GYAE6OF01BAJ57.18.17.B06.1.454.CMB.1.raw
  modified_base (359)..(364): a, c, t, g, unknown or other
  misc_feature (359)..(364): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttcccctggccgccctgctccaggagcacctccgagagcacagccggccctggggctgccgtggtcaaggactacttcccatactcgtactgagcgggctggccaaggcgcatagnnnnnn

SEQ ID NO: 200498 - DNA, 354 bp, Homo sapiens
  misc_feature: GYAE6OF01DWPL6.18.17.B06.1.454.CMB.1.raw
  modified_base (351)..(354): a, c, t, g, unknown or other
  misc_feature (351)..(354): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcgcagcggcctgggctgcctggtcaaggctacttcccatactcgtactgagcgggctggcaaggcgcatagnnnn

SEQ ID NO: 200499 - DNA, 360 bp, Homo sapiens
  misc_feature: GYAE6OF01BPIOF.18.17.B06.1.454.CMB.1.raw
  modified_base (351)..(360): a, c, t, g, unknown or other
  misc_feature (351)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttcccctggcgccctgctccaggacgcacctccgagagcacagcggccctggctgcctggtcaaggctactcccatactcgtactgagcggctggcaaggcgcatagnnnnnnnnnn

SEQ ID NO: 200500 - DNA, 358 bp, Homo sapiens
  misc_feature: GYAE6OF01DH4HC.18.17.B06.1.454.CMB.1.raw
  modified_base (354)..(358): a, c, t, g, unknown or other
  misc_feature (354)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgcctgctccaggagccacctccgagagcacagcggccctgggctgcctggtcaaggactactcccatactcgtactgagcgggctggcaaggcgcatagnnnnn

SEQ ID NO: 200501 - DNA, 369 bp, Homo sapiens
  misc_feature: GYAE6OF01B06J1.18.17.B06.1.454.CMB.1.raw
  modified_base (251)..(251): a, c, t, g, unknown or other
  misc_feature (251)..(251): n is a, c, g, or t
  modified_base (361)..(369): a, c, t, g, unknown or other
  misc_feature (361)..(369): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactagttggggccagggagccctggtcaccgtctcctcagcctccaccaagggcccatccggtcttccccnggccgcctgcctccaggacgcacctccgagagcacagccggccctggggctgccgtggtcaaggacctacttcccatactcgtactgagcgggctggcaaggcgcatagnnnnnnnnn

SEQ ID NO: 200502 - DNA, 393 bp, Homo sapiens
  misc_feature: GYAE6OF01ECEA4.18.17.B06.1.454.CMB.1.raw
  modified_base (277)..(277): a, c, t, g, unknown or other
  misc_feature (277)..(277): n is a, c, g, or t
  modified_base (382)..(393): a, c, t, g, unknown or other
  misc_feature (382)..(393): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcacgcctccaccgaacgggcccatccggtccttccccctggccgccctgcctccgaggacnccaccctccgagagcacgacgccggccctgggcctcgccgtggtacaacggtacctaccttcccatactcgtactggacgcgggctggacgaaggcgacagtagnnnnnnnnnnnn

SEQ ID NO: 200503 - DNA, 365 bp, Homo sapiens
  misc_feature: GYAE6OF01AN9VJ.18.17.B06.1.454.CMB.1.raw
  modified_base (356)..(365): a, c, t, g, unknown or other
  misc_feature (356)..(365): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctgctccaggagcacctccgagagcacagccggccctgggctgcctggtcaaggactacttctcatactcgtactgagcgggctggcaaggcgcatagnnnnnnnnnn

SEQ ID NO: 200504 - DNA, 444 bp, Homo sapiens
  misc_feature: GYAE6OF01BAZBY.18.17.B06.1.454.CMB.1.raw
  modified_base (133)..(133): a, c, t, g, unknown or other
  misc_feature (133)..(133): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (379)..(379): a, c, t, g, unknown or other
  misc_feature (379)..(379): n is a, c, g, or t
  modified_base (421)..(444): a, c, t, g, unknown or other
  misc_feature (421)..(444): n is a, c, g, or t
tcagtacgagtatgcacgaccggtgctcgatttagtcgatagtgaagggccgattcaccatctccagagacaattccaagaacacggtgtcaatgggaaatgaacagcctcgagagctgaggacgacggcgtntctatttcttcgtgcgaaggaacgacgatttggggtccggccatgaacttaccctacctttgtacgtaattggggtccggacgggaggccctcggtcgaccgtcctcctccacgcctcccaccaaacgggcccgactcggtccgttcccccttcggcggcccctcgctcccacggaggccaccctccgnggacncaaccagccggcccgtcggcgtgccgtggtcgaaaggaccgtacttccccanactcgctggagtcggggcctggcgaaacggcgctagtagacnnnnnnnnnnnnnnnnnnnnnnnn

SEQ ID NO: 200505 - DNA, 360 bp, Homo sapiens
  misc_feature: GYAE6OF01A4YZ7.18.17.B06.1.454.CMB.1.raw
  modified_base (351)..(360): a, c, t, g, unknown or other
  misc_feature (351)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctggctgcctggtcaaggctactcccatactcgtactgagcgggctggcaaggcgcatagnnnnnnnnnn

SEQ ID NO: 200506 - DNA, 379 bp, Homo sapiens
  misc_feature: GYAE6OF01DSKAQ.18.17.B06.1.454.CMB.1.raw
  modified_base (364)..(364): a, c, t, g, unknown or other
  misc_feature (364)..(364): n is a, c, g, or t
  modified_base (370)..(379): a, c, t, g, unknown or other
  misc_feature (370)..(379): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgccctgctccgaggacgccacctccgagacgcacagccggccctgggctcgccgtggtaccaaggacctaccttcccatacctcgtactgacgcgggctggcaaggcncatagnnnnnnnnnn

SEQ ID NO: 200507 - DNA, 358 bp, Homo sapiens
  misc_feature: GYAE6OF01A197I.18.17.B06.1.454.CMB.1.raw
  modified_base (348)..(348): a, c, t, g, unknown or other
  misc_feature (348)..(348): n is a, c, g, or t
  modified_base (354)..(358): a, c, t, g, unknown or other
  misc_feature (354)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggcccctgggctgcctggtcaaggactacttcccatactcgtactgagcgggctggcaaggcncatagnnnnn

SEQ ID NO: 200508 - DNA, 459 bp, Homo sapiens
  misc_feature: GYAE6OF01BQVL9.18.17.B06.1.454.CMB.1.raw
  modified_base (163)..(163): a, c, t, g, unknown or other
  misc_feature (163)..(163): n is a, c, g, or t
  modified_base (439)..(439): a, c, t, g, unknown or other
  misc_feature (439)..(439): n is a, c, g, or t
  modified_base (441)..(459): a, c, t, g, unknown or other
  misc_feature (441)..(459): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgtgaaggacacgatttggggccncatgaacttccactttgactagttggggccagggagccctggtcaccgtctcctcacgccctccaaccgaaagggcccctaactccgggttcccttccccccgtgggcccgccccttggacctcccgaagggacgcctaacccgtccggaagaacggccaacgacggcccggtcccctaggggcctggcccgtgggtaccaaaaggacccttaacctccccgaaatccgttccgaacctggaacgccggggctgggaccaaaggcccgataagagncnnnnnnnnnnnnnnnnnnn

SEQ ID NO: 200509 - DNA, 367 bp, Homo sapiens
  misc_feature: GYAE6OF01C78I4.18.17.B06.1.454.CMB.1.raw
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (360)..(367): a, c, t, g, unknown or other
  misc_feature (360)..(367): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcacgccctccaccaagggccccatccggtccttcccccgtggccgccctgctccgaggcgcacctccgagacgcacagcggcctgggctcgccgtggtcaaggactacctcatctcgtactgngcgggcnggacaggcacatgnnnnnnnn

SEQ ID NO: 200510 - DNA, 388 bp, Homo sapiens
  misc_feature: GYAE6OF01ARINS.18.17.B06.1.454.CMB.1.raw
  modified_base (376)..(376): a, c, t, g, unknown or other
  misc_feature (376)..(376): n is a, c, g, or t
  modified_base (381)..(388): a, c, t, g, unknown or other
  misc_feature (381)..(388): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgccctgcctccgaggagccaccctccggagacgccacagccggccctggggcctggcccttgggtccaacgggtaccttaccttcccatacctcgtacctggacggcgggctggcaggcncatgnnnnnnnn

SEQ ID NO: 200511 - DNA, 626 bp, Homo sapiens
  misc_feature: GYAE6OF01BUVKS.18.17.B06.1.454.CMB.1.raw
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
  modified_base (538)..(538): a, c, t, g, unknown or other
  misc_feature (538)..(538): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacggtatttggggccgctattgaactttccactttgactagttggggccagggacgcccgtggtccaccgtctccgtcacgccctccaccgaacgggccccagttcccggtacctttccccccgtggcccgtcccttcgcctccctaggactcctacccgtccggagacgccacgacggtccggcccctagggccgttcggcccgttacgggtccaaacgggtaccttaaccgtttaccccgagttaccgtacgtacggtacgacggccgggtactcggtaccgaagggtccgtacgaagtacgagactacgactgacncgtcgacgacgacgngacgacacnctacacgacgagtacgacgacacgacgacgacgtagcgacataganacgagacgacagtcgtcacgacgacgtacgtacgacgtacgtagtagtagacgagagtacgacgtacgtacgtagtacgtcgtagtag

SEQ ID NO: 200512 - DNA, 361 bp, Homo sapiens
  misc_feature: GYAE6OF01COKTS.18.17.B06.1.454.CMB.1.raw
  modified_base (355)..(361): a, c, t, g, unknown or other
  misc_feature (355)..(361): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtcttcccctggccgccctgctccaggacgccacctccgagagcacagccggcctgggctgcctggtcaaggacctacttccatactcgtactgagcgggctggcaaggcgcatagnnnnnnn

SEQ ID NO: 200513 - DNA, 438 bp, Homo sapiens
  misc_feature: GYAE6OF01A3WIH.18.17.B06.1.454.CMB.1.raw
  modified_base (420)..(438): a, c, t, g, unknown or other
  misc_feature (420)..(438): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagtttggggccgcatgaacttccactttgactagttggggccagggagccctggtccaccgtctcctcagccctccaccgaacgggccctagtccggtccttcccccgtggccgtcccctcgcctccgaggacgccacccgtccggagacgaccacgacggccggaccccgtggggcctcggccgtacgggtaccgaacgggtaccctaccttacccattacctcgtaactggacggcgggtctcgggaccgaacggcgacaagtagnnnnnnnnnnnnnnnnnnn

SEQ ID NO: 200514 - DNA, 360 bp, Homo sapiens
  misc_feature: GYAE6OF01EHSW9.18.17.B06.1.454.CMB.1.raw
  modified_base (344)..(344): a, c, t, g, unknown or other
  misc_feature (344)..(344): n is a, c, g, or t
  modified_base (350)..(360): a, c, t, g, unknown or other
  misc_feature (350)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttgggggccgcatgaacttccactttgactattggggccagggagccctggtcaccgtctcctcagcctccaccaagggcccatcggtccttcccctggcgccctgctccagtagcacctccgagagcacagcggcctgggctgcctgtcaaggctactccatactcgtactgagcgggctggcaaggcncatagnnnnnnnnnnn

SEQ ID NO: 200515 - DNA, 438 bp, Homo sapiens
  misc_feature: GYAE6OF01CV18Y.18.17.B06.1.454.CMB.1.raw
  modified_base (166)..(166): a, c, t, g, unknown or other
  misc_feature (166)..(166): n is a, c, g, or t
  modified_base (424)..(438): a, c, t, g, unknown or other
  misc_feature (424)..(438): n is a, c, g, or t
tcagtacgagtatgcacgaccggtgctcgatttagtcgatagtgaagggccgattcaccatctccagagacaattccaagaacacggtgtcaatggaaaatgaacagcctgagagctggaggacacggctgtctatttctgtgcgaaggacacgagtttggggccncatgaacttccactttgactagttggggccagggagccctggcaccgtctcctcacgccctccaacccgaaacgggtcccaacgtccgggttcctttccccccgtgggcccgcccctcggaccttccgacgggaagccaacccgttccgaagacgcaaccgacggccggcccctggggccttggccccttgggccaaaggccttactttccccatacctcgtaacctgacgcgggctggaccaaaggcgtacagtagnnnnnnnnnnnnnnn

SEQ ID NO: 200516 - DNA, 382 bp, Homo sapiens
  misc_feature: GYAE6OF01DLKOQ.18.17.B06.1.454.CMB.1.raw
  modified_base (370)..(382): a, c, t, g, unknown or other
  misc_feature (370)..(382): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactagttggggccagggagccctggtccaccgtcctcctcacgcctccaccaagggcccatccggtccttccccctggccgccctgctcccaggacgccaccgtccgagacgcacagcggccctgggctgccgtggtcaaggctaccttcccatctcgtactgacgcgggctggacgaaggcgcagtagnnnnnnnnnnnnn

SEQ ID NO: 200517 - DNA, 375 bp, Homo sapiens
  misc_feature: GYAE6OF01DGH33.18.17.B06.1.454.CMB.1.raw
  modified_base (278)..(278): a, c, t, g, unknown or other
  misc_feature (278)..(278): n is a, c, g, or t
  modified_base (357)..(357): a, c, t, g, unknown or other
  misc_feature (357)..(357): n is a, c, g, or t
  modified_base (364)..(375): a, c, t, g, unknown or other
  misc_feature (364)..(375): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagtttggggccgcatgaacttccactttgactagttggggccagggacgccctggtcaccgtctcctcagcctccaaccgaacgggcccatccggtccttcccccgtggccgcctgcctccaggcnccacctccgagagcacgagccggcctgggctgcctggtcaagctacttccatactcgactgagcgggctggcaacggcncagtagnnnnnnnnnnnn

SEQ ID NO: 200518 - DNA, 421 bp, Homo sapiens
  misc_feature: GYAE6OF01E0JND.18.17.B06.1.454.CMB.1.raw
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (372)..(421): a, c, t, g, unknown or other
  misc_feature (372)..(421): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagtttggggccgcatgaacttccactttgactattggggccagggagccctggtcaccgtctcctcagcctccaaccaacgggcccatccggtccttcccccgtggccgcccctgctaccgaggagcaccctcgagacgcacgagccggcctcgggcngcctggcaaggcctacctccatactcgtacgtgagcgggntgggacaaggcgacagtagcannnnnnnnnnnnnnnnnnnnnnnnnnnnnnnnnnnnnnnnnnnnnnnnnn

SEQ ID NO: 200519 - DNA, 467 bp, Homo sapiens
  misc_feature: GYAE6OF01EK9PV.18.17.B06.1.454.CMB.1.raw
  modified_base (430)..(430): a, c, t, g, unknown or other
  misc_feature (430)..(430): n is a, c, g, or t
  modified_base (433)..(467): a, c, t, g, unknown or other
  misc_feature (433)..(467): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagtttggggccgcatgaacttccactttgactagttggggccagggagccctggtcaccgtctcctcacgccctccaccgacggcccacgtccggtccttcccccgtggccgcccctcgcctcccgagggacgcctaccctcccgagacgccacaggccggccccgtggggcctcggccgtggggttaccaaacggggtaccttaccctttccccaattaccgttcgtaccttgacggtccggggtctcgggaccgaaagggccgaccgaataggcancgnnnnnnnnnnnnnnnnnnnnnnnnnnnnnnnnnnn

SEQ ID NO: 200520 - DNA, 375 bp, Homo sapiens
  misc_feature: GYAE6OF01AH571.18.17.B06.1.454.CMB.1.raw
  modified_base (345)..(345): a, c, t, g, unknown or other
  misc_feature (345)..(345): n is a, c, g, or t
  modified_base (371)..(375): a, c, t, g, unknown or other
  misc_feature (371)..(375): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgccctgctcccaggacgcaccctccgagagccacgagccggcccctggggcctgccgtggtcaaggactaccttcccattactcgtacngagcgggctgggcaaggcgacatagnnnnn

SEQ ID NO: 200521 - DNA, 407 bp, Homo sapiens
  misc_feature: GYAE6OF01DIZ8W.18.17.B06.1.454.CMB.1.raw
  modified_base (394)..(407): a, c, t, g, unknown or other
  misc_feature (394)..(407): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactagttggggccagggagccctggtcaccgtctcctcacgcctccaccgaagggcccatccggtccttcccccgtggccgcctgctccgaggacgccacctccgaagacgcacgacgccggcccgtgggcctcggcccttgggtaccgaaaggccttaaccttcccaatacctcgtacgtggacgccgggtctggacgaacggcgcagtacgnnnnnnnnnnnnnn

SEQ ID NO: 200522 - DNA, 360 bp, Homo sapiens
  misc_feature: GYAE6OF01CYDVM.18.17.B06.1.454.CMB.1.raw
  modified_base (267)..(267): a, c, t, g, unknown or other
  misc_feature (267)..(267): n is a, c, g, or t
  modified_base (347)..(347): a, c, t, g, unknown or other
  misc_feature (347)..(347): n is a, c, g, or t
  modified_base (353)..(360): a, c, t, g, unknown or other
  misc_feature (353)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggancacctccgagagcacagcggcctgggctgcctggtcaaggactacttcccatactcgtaactgagcgggctggcaaggcncatagnnnnnnnn

SEQ ID NO: 200523 - DNA, 372 bp, Homo sapiens
  misc_feature: GYAE6OF01DJKF5.18.17.B06.1.454.CMB.1.raw
  modified_base (360)..(372): a, c, t, g, unknown or other
  misc_feature (360)..(372): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggccccatccggtccttccccctggccgccctgctccaggagccacctccgagacgcacagccggccctgggctgcctggtcaaggactactccatactcgtactgagcgggctggcaaggcgcaatagnnnnnnnnnnnnn

SEQ ID NO: 200524 - DNA, 462 bp, Homo sapiens
  misc_feature: GYAE6OF01CDQXX.18.17.B06.1.454.CMB.1.raw
  modified_base (414)..(414): a, c, t, g, unknown or other
  misc_feature (414)..(414): n is a, c, g, or t
  modified_base (417)..(462): a, c, t, g, unknown or other
  misc_feature (417)..(462): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttgggggccgcatgaacttccacttttgactagttggggccagggagccctggtccaccgtctcctcacgccctccaccaagggcccatccggtccttccccctggccgccctgctccaggacgccacctccgagacgcacgagccggcccgtggggctcggcctgggtaccgaaacgggtaccttacccttccccaattacctcgttaaccgtggaacggtccggggcctgggaccgaacgggccgacgtaataggcancgnnnnnnnnnnnnnnnnnnnnnnnnnnnnnnnnnnnnnnnnnnnnnn

SEQ ID NO: 200525 - DNA, 418 bp, Homo sapiens
  misc_feature: GYAE6OF01C4QZ3.18.17.B06.1.454.CMB.1.raw
  modified_base (165)..(165): a, c, t, g, unknown or other
  misc_feature (165)..(165): n is a, c, g, or t
  modified_base (198)..(198): a, c, t, g, unknown or other
  misc_feature (198)..(198): n is a, c, g, or t
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
  modified_base (365)..(365): a, c, t, g, unknown or other
  misc_feature (365)..(365): n is a, c, g, or t
  modified_base (399)..(418): a, c, t, g, unknown or other
  misc_feature (399)..(418): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgacgaaggacacgtagttggggccncatgaaccttcacttgactagtgggccagggcnccctggtcaccgtctcctcacgcctccaccgaacggccctagtccggtccttccccgnggtccgccgttcgcctaccgaggaccnccacctccggagcgacacgtacggcccggccgtgggctacggccgtggtacaacggtcctactccctataccgttcgtaccngacggccgggtcacggcgaacggcgacaagcgannnnnnnnnnnnnnnnnnnn

SEQ ID NO: 200526 - DNA, 489 bp, Homo sapiens
  misc_feature: GYAE6OF01C998Z.18.17.B06.1.454.CMB.1.raw
  modified_base (172)..(172): a, c, t, g, unknown or other
  misc_feature (172)..(172): n is a, c, g, or t
  modified_base (437)..(437): a, c, t, g, unknown or other
  misc_feature (437)..(437): n is a, c, g, or t
  modified_base (440)..(443): a, c, t, g, unknown or other
  misc_feature (440)..(443): n is a, c, g, or t
  modified_base (445)..(446): a, c, t, g, unknown or other
  misc_feature (445)..(446): n is a, c, g, or t
  modified_base (448)..(489): a, c, t, g, unknown or other
  misc_feature (448)..(489): n is a, c, g, or t
tcagtacgagtatgcacgaccggtgctcgatttagtcgatagtgaagggccggattacaccatctccagagaccaattccaagaacacggtgtcaatggaaatgaacagcctgagagctgaggacacggctgtctatttctgtgcgaaggtacacggtagtttgggggcccncatgaaacctttccgaacttttgacttagttcgggggccaggggacgtcccctgggtccaccggttctacctcacgtccctccaaccgaagggcccctagttcccgggtcctttccccccgtggccctccccgtgcctcccgaggtacgccaaccgtccgagcgcacgtacggcggtccgtagggcgtgccggtgtaacgaaggtccttaacctcccgataccgtcgtaaccgtgacgacgggtctggaccaaggcagttacagngcnnnntnngnnnnnnnnnnnnnnnnnnnnnnnnnnnnnnnnnnnnnnnnnn

SEQ ID NO: 200527 - DNA, 366 bp, Homo sapiens
  misc_feature: GYAE6OF01DO65J.18.17.B06.1.454.CMB.1.raw
  modified_base (354)..(366): a, c, t, g, unknown or other
  misc_feature (354)..(366): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaactccacttgactatgggccagggagccctggtcaccgtctcctcagcctcaccaaggcccaatccggtcttccccctggccaccctcctccaagacgcacctcgtggggcacgagccggccctggctgcctggtcaaggactactccatactcgactgagtcgggctggacaaggcgacgatagnnnnnnnnnnnnn

SEQ ID NO: 200528 - DNA, 548 bp, Homo sapiens
  misc_feature: GYAE6OF01CZ93K.18.17.B06.1.454.CMB.1.raw
  modified_base (115)..(115): a, c, t, g, unknown or other
  misc_feature (115)..(115): n is a, c, g, or t
  modified_base (130)..(130): a, c, t, g, unknown or other
  misc_feature (130)..(130): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (443)..(444): a, c, t, g, unknown or other
  misc_feature (443)..(444): n is a, c, g, or t
  modified_base (446)..(446): a, c, t, g, unknown or other
  misc_feature (446)..(446): n is a, c, g, or t
  modified_base (450)..(451): a, c, t, g, unknown or other
  misc_feature (450)..(451): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (519)..(519): a, c, t, g, unknown or other
  misc_feature (519)..(519): n is a, c, g, or t
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
  modified_base (541)..(541): a, c, t, g, unknown or other
  misc_feature (541)..(541): n is a, c, g, or t
  modified_base (543)..(545): a, c, t, g, unknown or other
  misc_feature (543)..(545): n is a, c, g, or t
tcagtacgagtatgcacgaccggtgctcgatttagtcgatagtgaaggggccgattcaccatctccagagacaattccaagaacacggtgtcaatggaaatgaacagcctgaganctggaggacacggtntctatttcgtgtagacgaaggaacgtacgtagttgggtccggccatagtaaccttaccctcgtttagtcgagtttcggggcggagggagccctcgtacgtcgccctctcagcctcccaacgaacgggcctactcggtccgttccccttacggaggacccctcgacgaccacggagtaccgaccaccggagaacgcgacacggtccggccgtacgggcgtcgtacgcggttacgaaacgaccgtacttacccgtatacgacctagtacgagcggaccgtagacggaacggtcggccaagtacggnganacacgnnanacannacagagaganganananangatagagagatnanananananagnagagangagnganagananannananagananangacngacgacanannngac

SEQ ID NO: 200529 - DNA, 403 bp, Homo sapiens
  misc_feature: GYAE6OF01AR54U.18.17.B06.1.454.CMB.1.raw
  modified_base (382)..(403): a, c, t, g, unknown or other
  misc_feature (382)..(403): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaagggcccatccggtccttccccctggccgcccctgctccaggacgccacctccgagacgcacgagccggcccctggggcctgcccgtggtaccaaacgggtacctacctttcccatacctcgtactgaagccgggctggccaaggcgcagtagnnnnnnnnnnnnnnnnnnnnnn

SEQ ID NO: 200530 - DNA, 526 bp, Homo sapiens
  misc_feature: GYAE6OF01D4RO0.18.17.B06.1.454.CMB.1.raw
  modified_base (492)..(526): a, c, t, g, unknown or other
  misc_feature (492)..(526): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttgggggccgcatgtaacttccactttgactagttgggggccaggggacgccccgtggtccacccgtcctccctcacgccctccaaccgaacgggccccagttcccgggtcccttccccccgtgggcccgtcccctgcctaccgacggaccgcccacccgtccggacgacgaccaccgaccggcccggtccccggtcggggtccgtccggtccggttacgggtaaccgtaaaccgggtaacccttacccgttacccctaacgttacccgttaccggttaacggtacgggaccgggtccggggtccggtacgggaaccggaacgggaccgacgagtagnnnnnnnnnnnnnnnnnnnnnnnnnnnnnnnnnnn

SEQ ID NO: 200531 - DNA, 468 bp, Homo sapiens
  misc_feature: GYAE6OF01A4QEY.18.17.B06.1.454.CMB.1.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (434)..(468): a, c, t, g, unknown or other
  misc_feature (434)..(468): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagcccctggtcaccgtctcctcagcctccaccaaggcccatcggtctccccngcgcctgctccaggncacctccgagacgcacgagccggccccgtgggcctcggtcccgtgggtaccgaaacgggtaacccttaccctttaccccgaacgtttacccttaccggttaaccgttaggaacgggcccggggtacgttcggggaccgaaaggggccgaccgtaagtaaaggccagctgcnnnnnnnnnnnnnnnnnnnnnnnnnnnnnnnnnnn

SEQ ID NO: 200532 - DNA, 658 bp, Homo sapiens
  misc_feature: GYAE6OF01DEHPI.18.17.B06.1.454.CMB.1.raw
  modified_base (600)..(601): a, c, t, g, unknown or other
  misc_feature (600)..(601): n is a, c, g, or t
  modified_base (604)..(608): a, c, t, g, unknown or other
  misc_feature (604)..(608): n is a, c, g, or t
  modified_base (610)..(658): a, c, t, g, unknown or other
  misc_feature (610)..(658): n is a, c, g, or t
tcagtacgagtatgcacgaccggtgctcgatttagtcgatagtgaagggccgattcaccatctccagagacaattccaagaacacggtgtcaaatggaaatgaacagcctgagagctggaggacacggctgtcttatttctggtgcggaaaggacacgtagtttcgggggccactatacgtaacctttcctaacgttttggaccttaggttcgggggacccgaagggggtaccgtccccgttagggtccctaacccggttcccttcccgtccgaacggtcccccttaccccgaaaccggaaaccgggggccccttaacggttccccggggttcccccttttcccccccggtggggcccgtcccccgttacggtcccttcccccggaaaggggacccggtccaaccccccgttcgggacgaacggcccgaacccgaggccccggggtcccccgttagggggcccgtacggtcccgttcgggtaactaaacggggtacccttacccgttacccgtaacttaacccggtcccgtttacgtcggaacggggccggggaccttacggggaccgtaaacggggtccacggtaactagcgatcgatnncgnnnnngnnnnnnnnnnnnnnnnnnnnnnnnnnnnnnnnnnnnnnnnnnnnnnnnn

SEQ ID NO: 200533 - DNA, 447 bp, Homo sapiens
  misc_feature: GYAE6OF01EYG7Q.18.17.B06.1.454.CMB.1.raw
  modified_base (414)..(415): a, c, t, g, unknown or other
  misc_feature (414)..(415): n is a, c, g, or t
  modified_base (418)..(447): a, c, t, g, unknown or other
  misc_feature (418)..(447): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgtatttggggccgcaatgaacttcctactttgactagttggggccagggacgccctggtcaccgtctcctcacgccctccaccgacgggcccagtccggtccttccccctggccgtcccctgcctcccgaggacgccaccctccggagtacgccaaccgaggcccggccccgtgggcctcggtcccgtcggtcgaaacgggaccttaccgttaccccagtacctcgtaactggacggccgggctggacaaggcgacagtacgnntgnnnnnnnnnnnnnnnnnnnnnnnnnnnnnn

SEQ ID NO: 200534 - DNA, 639 bp, Homo sapiens
  misc_feature: GYAE6OF01E4H69.18.17.B06.1.454.CMB.1.raw
  modified_base (489)..(489): a, c, t, g, unknown or other
  misc_feature (489)..(489): n is a, c, g, or t
  modified_base (494)..(495): a, c, t, g, unknown or other
  misc_feature (494)..(495): n is a, c, g, or t
  modified_base (504)..(504): a, c, t, g, unknown or other
  misc_feature (504)..(504): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
  modified_base (610)..(610): a, c, t, g, unknown or other
  misc_feature (610)..(610): n is a, c, g, or t
  modified_base (634)..(634): a, c, t, g, unknown or other
  misc_feature (634)..(634): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttcgtgtgcgaagacacgtagtttggggccacatgtaaccttcctactttgacttagttcggggccagggactcccgtggtccaccgtcctcctcgacgtcctaccaccgaacgggcccctacgttccggttacccttcccccgtgggacccgccccgtacggtaccctaccgacggtaccgacccgtacccgtaccggacgacgtaccaccgtaccggcccggtcccgtgggaccgtcggacccgtagggtaacccgaacggttacccttacccgttaccccgaacttaccgttaccgttacggcggaacggggtcgggtcgacgggtaccggaaacggtcgacgtaagtagcncgtcnncgtacagcngtactgactcggntacgtngttcgntagtacggtcagngtacngcngactcngtcactcacgttcacgtagtcgtcgacgtctagcttagtaacgtcgtacgcgtnactcgcgtagctgactgtaccgcncgtcg

SEQ ID NO: 200535 - DNA, 464 bp, Homo sapiens
  misc_feature: GYAE6OF01BCX9S.18.17.B06.1.454.CMB.1.raw
  modified_base (434)..(464): a, c, t, g, unknown or other
  misc_feature (434)..(464): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagtttggggccgcatgaacttcctactttgacttagttggggccagggacgccctggtccaccgtcctccctcacgccctccaccgaacgggcccagtcccggttccttccccctgggccgcccctcgcctccgacggacgccacccgtccgagacgccacgagccgggccccgtgggcctcggccgtgggtacgaacgggtacctaccgtttaccccaattaccgttaccgtacgtcggacggtccggggtctacgggacgaacggccgacaacgtaggcnnnnnnnnnnnnnnnnnnnnnnnnnnnnnnn

SEQ ID NO: 200536 - DNA, 388 bp, Homo sapiens
  misc_feature: GYAE6OF01A6ITK.18.17.B06.1.454.CMB.1.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (377)..(388): a, c, t, g, unknown or other
  misc_feature (377)..(388): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgttcgaaggacacgatttggggccgcatgaacttccactttgactattggggccagggagccctggtcaccgtctcctcagcctccaccaaggcccatccggtccttccccctggccgtccctcgcctccgacggacgccaccctccggagacgcaccaggccggcccgtgggctgccgtggtcaaggacctacgttcccaatacctcgtactgagcgggctggacaaggcnctaangnnnnnnnnnnnn

SEQ ID NO: 200537 - DNA, 360 bp, Homo sapiens
  misc_feature: GYAE6OF01CQXHS.18.17.B06.1.454.CMB.1.raw
  modified_base (353)..(360): a, c, t, g, unknown or other
  misc_feature (353)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaagggcccatcggtcttccccctggcgccctgctccaggagccacctccgagagcacagccggcctgggctgcctggtcaaggacacttccatactcgtactgagcgggctggcaaggcgcatgnnnnnnnn

SEQ ID NO: 200538 - DNA, 786 bp, Homo sapiens
  misc_feature: GYAE6OF01BOG79.18.17.B06.1.454.CMB.1.raw
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (584)..(584): a, c, t, g, unknown or other
  misc_feature (584)..(584): n is a, c, g, or t
  modified_base (620)..(620): a, c, t, g, unknown or other
  misc_feature (620)..(620): n is a, c, g, or t
tcagtacgagtatgcacgaccggtgctcgattttagtcgatagtgaagggtccggtagttcgaccatctccagagacaattccaagaacacggtgtcaatgggaaactgaacagcctgaggagcctgaggacacggcttgtcttactttcgtacgtgcgaaggacacgtagtttcggggaccgcactcgtaaccttccctactttcgaccttagtttcggggccgagggtacgtccccgtttggtaccgtacccgttaccgttcccgtaccacgaccccttacccaacccgtaaacgggtccccgaaccggttccgggttccctttccccccgtggccccgtccctgtcccgtaccgaggtactcccgtacccgtccggtagacgaccaacgaccggaccgggacccggtcggggaccctccgccccgttacggggtacgaaacgggttaccctttaaccgttttcccccgtaaagtttaccttacgggttaaccctacgggtaacgggtccgggtccgttacgggaaccggaacgggtccgtaccgtaaaggttcgagttcgaacggcgnggtanacgtacgngtacgacgtacacgtcactacagtctacgtcgtacncgtcgtacgcgtcgtacgtacgtacgtagttacgttacgttacttacgttagttacgtacgttacgtacgtacgttaacgtacgtacgttaccgtccggtaccgtaccgtacggtaccgtacgtacggtcggtacgtaccgacgtacgtacgacgcgtgtcgtacg

SEQ ID NO: 200539 - DNA, 687 bp, Homo sapiens
  misc_feature: GYAE6OF01EZULA.18.17.B06.1.454.CMB.1.raw
  modified_base (168)..(168): a, c, t, g, unknown or other
  misc_feature (168)..(168): n is a, c, g, or t
  modified_base (213)..(213): a, c, t, g, unknown or other
  misc_feature (213)..(213): n is a, c, g, or t
  modified_base (297)..(297): a, c, t, g, unknown or other
  misc_feature (297)..(297): n is a, c, g, or t
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (532)..(532): a, c, t, g, unknown or other
  misc_feature (532)..(532): n is a, c, g, or t
tcagtacgagtatgcacgaccggtgctcgattttagtcgatagtgaagggccgtagttcaccatctccagagacaattccaagaacacggtgtcaatggaaatgaacagcctgagagctgaggacacggctgtctatttcgtgtgcgaagactacgtagtttgggccncagtgtaacttccgtactttgacgttaggttgggccgtagggacncccgttggtcctaccggtcctccgcgaccgtcccgtacccaaccggtaccgggccccgtacgttccggttaccccgttccccgnggtccgtccccgtcgcctcccgaagggaccgtccacccgttaccggaagtccgacaacgtcggcccggtccccgtgggtctcccggaccggttcggaccgaaacggtaccgttaccttcccgagttccgtacgtcgtacggacggtcgggtacgtacggacggaaacggtccgaagtacgtaaggcctaggtcaggtnacgnttacggntgtacgngtccgtancttcgaacgtncgacgacgtacgatacgtatagtactacgtacgtacgtacgtacgtacgtacgacgtcgtaccgaccgacgtacgtaccgtacgtagttagtacgtgacggtacgtacgtaggacggtacgacgtacgtaagtacgtacgacgtacgttgcgtac

SEQ ID NO: 200540 - DNA, 549 bp, Homo sapiens
  misc_feature: GYAE6OF01CZZ7O.18.17.B06.1.454.CMB.1.raw
  modified_base (298)..(298): a, c, t, g, unknown or other
  misc_feature (298)..(298): n is a, c, g, or t
  modified_base (493)..(493): a, c, t, g, unknown or other
  misc_feature (493)..(493): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (505)..(549): a, c, t, g, unknown or other
  misc_feature (505)..(549): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgacgaaggacacgtagttggggcccgatatagtaaccttccctaacgtttgactagttcgggggcccgaaggggccgtacccgtgggtcctaccggtcctccctcacggccctacccgaacccgaaacgggccctaagtcccggtccctttcccccgnggccccgtacccgtcggacctacccggaagggaccgaccctaacccgtacggaacgaccgcccaaggaccggtcccggaccccggtgggtcctaccggccgtaccgggtaacaaacggtacccttacccgttacccaataaccggtcgttaccgaggccgggtacgggccgtagggaccgaaagggctaacgaanaggntaggntgnnnnnnnnnnnnnnnnnnnnnnnnnnnnnnnnnnnnnnnnnnnnn

SEQ ID NO: 200541 - DNA, 572 bp, Homo sapiens
  misc_feature: GYAE6OF01DE662.18.17.B06.1.454.CMB.1.raw
  modified_base (114)..(114): a, c, t, g, unknown or other
  misc_feature (114)..(114): n is a, c, g, or t
  modified_base (127)..(127): a, c, t, g, unknown or other
  misc_feature (127)..(127): n is a, c, g, or t
  modified_base (133)..(133): a, c, t, g, unknown or other
  misc_feature (133)..(133): n is a, c, g, or t
  modified_base (164)..(164): a, c, t, g, unknown or other
  misc_feature (164)..(164): n is a, c, g, or t
  modified_base (521)..(521): a, c, t, g, unknown or other
  misc_feature (521)..(521): n is a, c, g, or t
  modified_base (525)..(572): a, c, t, g, unknown or other
  misc_feature (525)..(572): n is a, c, g, or t
tcagtacgagtatgcacgaccggtgctcgatttagtcgatagtgaagggccgattcaccatctccagagacaattccaagaacacggtgtcaatggaaatgaacagcctgaganctggagacacggntgtctntttctgtgcgaagacacgtagttcggggccncgatcgtaaaccttcctacgttttagacttacggttcggggccgaagggcgtccccgtgggtacctaccgtcctccctgaccgtcccctacccgaacccggaaccgggtccctacggttcccgggttccccctttccccccgtacggaccccgtcccgttccggacccctccgaacgggaccacccgaacccgtcggaacgaccgcccaacgtaccggccccgggtcccggtggtccgtcgtcccgtacggtaaccgaaaccggttaccctacccgtttacccgaacgttaccgttaccggaacgttcgggccggcggggtacgtcgggtaaccggaaccgtcgacgtaaaggcgcntacnnnnnnnnnnnnnnnnnnnnnnnnnnnnnnnnnnnnnnnnnnnnnnnn

SEQ ID NO: 200542 - DNA, 364 bp, Homo sapiens
  misc_feature: GYAE6OF01C63BX.18.17.B06.1.454.CMB.1.raw
  modified_base (294)..(294): a, c, t, g, unknown or other
  misc_feature (294)..(294): n is a, c, g, or t
  modified_base (353)..(364): a, c, t, g, unknown or other
  misc_feature (353)..(364): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttccccctggcgccctgctccaggagcactccgagagcacagcgcctggcngcctggtcaaggactactcccatactcgtactgacgcgggctggacaggcgacagtagnnnnnnnnnnnn

SEQ ID NO: 200543 - DNA, 453 bp, Homo sapiens
  misc_feature: GYAE6OF01DKXR9.18.17.B06.1.454.CMB.1.raw
  modified_base (212)..(212): a, c, t, g, unknown or other
  misc_feature (212)..(212): n is a, c, g, or t
  modified_base (292)..(292): a, c, t, g, unknown or other
  misc_feature (292)..(292): n is a, c, g, or t
  modified_base (322)..(322): a, c, t, g, unknown or other
  misc_feature (322)..(322): n is a, c, g, or t
  modified_base (420)..(453): a, c, t, g, unknown or other
  misc_feature (420)..(453): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgtagtttcggggccgcatgaacctttcctacttttgacttagttcggggaccgaggggacncccgtaggtccacccgtcctcctcacgccctccaaccgaacgggcccctagtccggttccttcccccgtggcccgtcccncgacctccgaggacgccaccctcggagacncacgacggccggccgtggctcgcctggacgaacggtctaccttcccataccgtactacgtcggacggcgggtacgtggacgacgggtcacgaagtcgnnnnnnnnnnnnnnnnnnnnnnnnnnnnnnnnnn

SEQ ID NO: 200544 - DNA, 692 bp, Homo sapiens
  misc_feature: GYAE6OF01BT3KJ.18.17.B06.1.454.CMB.1.raw
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
  modified_base (524)..(524): a, c, t, g, unknown or other
  misc_feature (524)..(524): n is a, c, g, or t
tcagtacgagtatgcacgaccggtgctcgatttagtcgatagtgaaggccgattcaccatctccagagacaattccaagaacacggtgtcaatggaaatgaacagcctgagagctgaggacacggctgtcttactttcgtgtcgacgaacggacacgtagttttcggggaccactatcgtaaacctttccctacgttttagaccgttagtttcggggaccgagggacgtcccgttggtcctacccggttcctaccgtaccgtaccgcccttaccgaacccggtaaccggcccctaacgttcccggttcctttcccccgttgggccctcccgtcgaccgtccgaggaccgtccaccgtcgacgtacgcaacgacgcccggaccgtggacctcggtccgcggtacgaacggtacctttccgtactaccgtacgtaccgttacgtacgggtcgtccgggtacttaccgggacgaaccggtcggtacgtactaggccgagcggngacgacgacgacgnagacgtacgngacgacgacgacacgcgtacgtacgtcgtcgtcgtacagtacgtactagtacgcgtcgactcgtcgacgtacgacgtacgtacgtacgtacgtacgtacgtacgtaccgtacgtatcgtacgacgtcgtacgtacgacgtaaccgtaacgtacgacgtccgcggaccg

SEQ ID NO: 200545 - DNA, 500 bp, Homo sapiens
  misc_feature: GYAE6OF01CQELY.18.17.B06.1.454.CMB.1.raw
  modified_base (295)..(295): a, c, t, g, unknown or other
  misc_feature (295)..(295): n is a, c, g, or t
  modified_base (458)..(461): a, c, t, g, unknown or other
  misc_feature (458)..(461): n is a, c, g, or t
  modified_base (463)..(500): a, c, t, g, unknown or other
  misc_feature (463)..(500): n is a, c, g, or t
tcagtacgagtatgcacgaccggtgctcgatttagtcgatagtgaagggccgattcaccatctccagagacaattccaaagaacacggtgtcaatggaaatgaacagcctgagagctggaggacacggctgtctatttctgtgcgaaggacacgtagtttggggcccgcatcgtaacttccctactttgacttagttcgggggaccagggacgtccccgtggtccacccggttcctcctcgaacgcccttcccaaccgaacgggccctacgtccggttccttccccccgtggccnccccgtgcctccgaggacgcctaccctccggagtacgccacacgggcccggtcccaggggccttcggccctgggtcgaaacggtacccttaccttaccccgtagttacccttcgttaaaccgtgacgggtcgggccttcggaccggaggccgactaataggcnnnncnnnnnnnnnnnnnnnnnnnnnnnnnnnnnnnnnnnnnn

SEQ ID NO: 200546 - DNA, 439 bp, Homo sapiens
  misc_feature: GYAE6OF01B23LV.18.17.B06.1.454.CMB.1.raw
  modified_base (282)..(282): a, c, t, g, unknown or other
  misc_feature (282)..(282): n is a, c, g, or t
  modified_base (409)..(409): a, c, t, g, unknown or other
  misc_feature (409)..(409): n is a, c, g, or t
  modified_base (411)..(439): a, c, t, g, unknown or other
  misc_feature (411)..(439): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgtagtttgggggccgcgatgaacttccacttttgactagttcggggccagggacgccctggtcctacccgtctcctcacgtccctaccgacccgaacgggcccagttccggtcccttcccccgtaggcccnccctcgcctaccgaggacgccacccgtccgagacgaccacgacggccggccctggggctcggccgtggtacgaacggtacctacctccatactcgtactggacgcgggctggacgaggcgcagtagnannnnnnnnnnnnnnnnnnnnnnnnnnnnn

SEQ ID NO: 200547 - DNA, 600 bp, Homo sapiens
  misc_feature: GYAE6OF01DDA6O.18.17.B06.1.454.CMB.1.raw
  modified_base (113)..(113): a, c, t, g, unknown or other
  misc_feature (113)..(113): n is a, c, g, or t
  modified_base (126)..(126): a, c, t, g, unknown or other
  misc_feature (126)..(126): n is a, c, g, or t
  modified_base (139)..(139): a, c, t, g, unknown or other
  misc_feature (139)..(139): n is a, c, g, or t
  modified_base (373)..(373): a, c, t, g, unknown or other
  misc_feature (373)..(373): n is a, c, g, or t
  modified_base (416)..(416): a, c, t, g, unknown or other
  misc_feature (416)..(416): n is a, c, g, or t
  modified_base (488)..(488): a, c, t, g, unknown or other
  misc_feature (488)..(488): n is a, c, g, or t
  modified_base (541)..(542): a, c, t, g, unknown or other
  misc_feature (541)..(542): n is a, c, g, or t
  modified_base (544)..(547): a, c, t, g, unknown or other
  misc_feature (544)..(547): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (557)..(560): a, c, t, g, unknown or other
  misc_feature (557)..(560): n is a, c, g, or t
  modified_base (562)..(562): a, c, t, g, unknown or other
  misc_feature (562)..(562): n is a, c, g, or t
  modified_base (564)..(565): a, c, t, g, unknown or other
  misc_feature (564)..(565): n is a, c, g, or t
  modified_base (567)..(571): a, c, t, g, unknown or other
  misc_feature (567)..(571): n is a, c, g, or t
  modified_base (574)..(600): a, c, t, g, unknown or other
  misc_feature (574)..(600): n is a, c, g, or t
tcagtacgagtatgcacgaccggtgctcgatttagtcgatagtgaagggccgattcaccatctccagagacaattccaagaacacggtgtcaatggaaatgaacagcctaganagctgagacacgntgtcttatttcgngtagcgaaaggacctacgagttttcggggaccactatacgtaactttcccgtatttagacttaggttacggggccggagggacgtcccgtgggtacctacccgtccttccaccaaccgtcccctaacccgaaacccggaacgggtcccctaacgttcccggtttcccccttcccccgtgggccctaacccttcgggaccacccggacggacgtaccctacccgtaaccggaaanaccgtaacgccgaccggttcccgggtccccttgggggaccccncggttaccctagggtaaacccgaaacggttacccttaccgtttcccaaacgtttccgtaccggttaaaccgngggccggacgggtttcccgaagggaccccgtaggggaccaaagtaacggtcanncnnnngcncnanagnnnnancnncnnnnntcnnnnnnnnnnnnnnnnnnnnnnnnnnn

SEQ ID NO: 200548 - DNA, 579 bp, Homo sapiens
  misc_feature: GYAE6OF01AE8IY.18.17.B06.1.454.CMB.1.raw
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (521)..(522): a, c, t, g, unknown or other
  misc_feature (521)..(522): n is a, c, g, or t
  modified_base (524)..(525): a, c, t, g, unknown or other
  misc_feature (524)..(525): n is a, c, g, or t
  modified_base (527)..(530): a, c, t, g, unknown or other
  misc_feature (527)..(530): n is a, c, g, or t
  modified_base (534)..(536): a, c, t, g, unknown or other
  misc_feature (534)..(536): n is a, c, g, or t
  modified_base (538)..(541): a, c, t, g, unknown or other
  misc_feature (538)..(541): n is a, c, g, or t
  modified_base (543)..(544): a, c, t, g, unknown or other
  misc_feature (543)..(544): n is a, c, g, or t
  modified_base (546)..(548): a, c, t, g, unknown or other
  misc_feature (546)..(548): n is a, c, g, or t
  modified_base (550)..(579): a, c, t, g, unknown or other
  misc_feature (550)..(579): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgtagttggggccgcatgaaccttccactttgacttagttggggccgagggacgcccgtggtcctacccgtcctccctcacggccctacccgaaccgacgggtcccctacgttccggttcccttccccccgtcggcccgtccccgtcggcctacccgaggaccgccctaccgtacccggagacgaccgaccgacgggcccgggtccccgtcggggtcctcgggtcccggtacggtaccgtaaacgggtacccttaacccgtttacccgaacgttacccgttacccggtacgttcggggtaaccgggtccggggtccgtacggggacgaaaccgggtccggtaacgtacgtaggntacgcgngacancgacnnanncnnnngtcnnngnnnntnntnnncnnnnnnnnnnnnnnnnnnnnnnnnnnnnnn

SEQ ID NO: 200549 - DNA, 356 bp, Homo sapiens
  misc_feature: GYAE6OF02G4WXI.18.17.B06.1.454.CMB.1.raw
  modified_base (353)..(356): a, c, t, g, unknown or other
  misc_feature (353)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctacttcccatactcgtactgagcgggctggcaaggcgcatagnnnn

SEQ ID NO: 200550 - DNA, 358 bp, Homo sapiens; identical to SEQ ID NO: 200426
  misc_feature: GYAE6OF02H3X0H.18.17.B06.1.454.CMB.1.raw
  modified_base (354)..(358): a, c, t, g, unknown or other
  misc_feature (354)..(358): n is a, c, g, or t

SEQ ID NO: 200551 - DNA, 356 bp, Homo sapiens; identical to SEQ ID NO: 200436
  misc_feature: GYAE6OF02HISJ8.18.17.B06.1.454.CMB.1.raw
  modified_base (353)..(356): a, c, t, g, unknown or other
  misc_feature (353)..(356): n is a, c, g, or t

SEQ ID NO: 200552 - DNA, 370 bp, Homo sapiens
  misc_feature: GYAE6OF02HV5E0.18.17.B06.1.454.CMB.1.raw
  modified_base (354)..(370): a, c, t, g, unknown or other
  misc_feature (354)..(370): n is a, c, g, or t
tcagtacgagtatgcacgaccggtgctcgatttagtcgatagtgaagggccgattcaccatctccagagacaattccaagaacacggtgtcaatggaaatgaacagcctgagagcgtgaggacacggctgtctatttctgtgcgaaggacacgatttggggccgcatgaacttccactttgactattggggccagggagccctggtcaccgtctcctcagcctaccaccaagggcccatcggtcttcccctggcgccctgctccaggagcacctccgagagcacagcggccctgggctgcctggtcaaggctacttcccatactcgtactgagcgggctggcaaggcgcatagnnnnnnnnnnnnnnnnn

SEQ ID NO: 200553 - DNA, 356 bp, Homo sapiens; identical to SEQ ID NO: 200549
  misc_feature: GYAE6OF02F6WGF.18.17.B06.1.454.CMB.1.raw
  modified_base (353)..(356): a, c, t, g, unknown or other
  misc_feature (353)..(356): n is a, c, g, or t

SEQ ID NO: 200554 - DNA, 357 bp, Homo sapiens
  misc_feature: GYAE6OF02G7EOF.18.17.B06.1.454.CMB.1.raw
  modified_base (352)..(357): a, c, t, g, unknown or other
  misc_feature (352)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggcctgggctgcctggtcaaggctacttcccatactcgtactgagcgggctggcaaggcgcatagnnnnnn

SEQ ID NO: 200555 - DNA, 359 bp, Homo sapiens
  misc_feature: GYAE6OF02ILP8T.18.17.B06.1.454.CMB.1.raw
  modified_base (353)..(359): a, c, t, g, unknown or other
  misc_feature (353)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtcttccccctggcgccctgctccaggagcacctccgagagcacagcggccctgggctgcctggtcaaggactactcccatactcgtactgagcggctggcaaggcgcatagnnnnnnn

SEQ ID NO: 200556 - DNA, 364 bp, Homo sapiens
  misc_feature: GYAE6OF02FWVXC.18.17.B06.1.454.CMB.1.raw
  modified_base (348)..(348): a, c, t, g, unknown or other
  misc_feature (348)..(348): n is a, c, g, or t
  modified_base (354)..(364): a, c, t, g, unknown or other
  misc_feature (354)..(364): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggccgccctgctccaggagcacctccgagagcacagcggccctgggctgcctggtcaaggactacttcccatactcgtactgagcgggctggcaaggcncatagnnnnnnnnnnn

SEQ ID NO: 200557 - DNA, 358 bp, Homo sapiens
  misc_feature: GYAE6OF02JGY2P.18.17.B06.1.454.CMB.1.raw
  modified_base (353)..(358): a, c, t, g, unknown or other
  misc_feature (353)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctacttcccatactcgtactgagcgggctggcaaggcgcatagnnnnnn

SEQ ID NO: 200558 - DNA, 355 bp, Homo sapiens
  misc_feature: GYAE6OF02IXQK9.18.17.B06.1.454.CMB.1.raw
  modified_base (351)..(355): a, c, t, g, unknown or other
  misc_feature (351)..(355): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctactcccatactcgtactgagcggctggcaaggcgcatagnnnnn

SEQ ID NO: 200559 - DNA, 377 bp, Homo sapiens
  misc_feature: GYAE6OF02IP9Z0.18.17.B06.1.454.CMB.1.raw
  modified_base (361)..(362): a, c, t, g, unknown or other
  misc_feature (361)..(362): n is a, c, g, or t
  modified_base (364)..(377): a, c, t, g, unknown or other
  misc_feature (364)..(377): n is a, c, g, or t
tcagtacgagtatgcacgaccggtgctcgatttagtcgatagtgaagggccggattcaccatctccagagacaattccaagaacacggtacgtcaatggaaatgaacagcctgagagctgaggacacggctgtctatttactgtgcgaaggacacgatttggggccgcatgaacttccactttgactattggggccagggagccctggtcaccgtctcctcagcctccaccaagggcccatccggtcttccccctggcgccctgctcccaggacgcacctccgagacgcacagcgccctggggctgcctggtcaaggctacgtcccatactcgtactgagcgggctggcaaggcgcatagnngnnnnnnnnnnnnnn

SEQ ID NO: 200560 - DNA, 358 bp, Homo sapiens; identical to SEQ ID NO: 200426
  misc_feature: GYAE6OF02IPH4T.18.17.B06.1.454.CMB.1.raw
  modified_base (354)..(358): a, c, t, g, unknown or other
  misc_feature (354)..(358): n is a, c, g, or t

SEQ ID NO: 200561 - DNA, 373 bp, Homo sapiens
  misc_feature: GYAE6OF02H7GLN.18.17.B06.1.454.CMB.1.raw
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
  modified_base (353)..(373): a, c, t, g, unknown or other
  misc_feature (353)..(373): n is a, c, g, or t
tcagtacgagtatgcacgaccggtgctcgattttagtcgatagtgaagggccgagttcaccatctccagagacaattccaagaacacggtgtcaatggaaatgaacagcctgagagctgaggagacggctggtctatttctgtgcgaaggacacgatttggggccgcatgaacttcactttgactattggggccagggagccctggtcaccgtctcctcagcctccaccaagggcccatcggtcttcccctggcgccctgctccaggancacctcgagagcacagcggcctgggctgcctggtcaaggctacttcccatactcgtactgagcggggctggcaaggcgnatagnnnnnnnnnnnnnnnnnnnnn

SEQ ID NO: 200562 - DNA, 358 bp, Homo sapiens
  misc_feature: GYAE6OF02GDCTD.18.17.B06.1.454.CMB.1.raw
  modified_base (353)..(358): a, c, t, g, unknown or other
  misc_feature (353)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggactacttcccatactcgtactgagcgggctggcaaggcgcatagnnnnnn

SEQ ID NO: 200563 - DNA, 359 bp, Homo sapiens
  misc_feature: GYAE6OF02IZZTO.18.17.B06.1.454.CMB.1.raw
  modified_base (354)..(359): a, c, t, g, unknown or other
  misc_feature (354)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgtactgagcgggctggcaaggcgcatagnnnnnn

SEQ ID NO: 200564 - DNA, 372 bp, Homo sapiens
  misc_feature: GYAE6OF02IQR7V.18.17.B06.1.454.CMB.1.raw
  modified_base (358)..(372): a, c, t, g, unknown or other
  misc_feature (358)..(372): n is a, c, g, or t
tcagtacgagtatgcacgaccggtgctcgatttagtcgatagtgaagggccggattcaccatctccagagacaattccaagaacacggtgtcaatggaaatgaacagcctgagagctgaggacacggctgtcgtatttctgtgtcgaaggacacgatttggggccgcatgaacttcactttgactattggggccagggagcccgtggtcaccgtctcctcagcctcaccaagggcccatcggtcttccccctggccgccctgctccaggagcacctccgagagcacagcggcccctgggctgcctggtcaaggactacttcccatactcgtactgagcgggctggcaaggcgcatagnnnnnnnnnnnnnnn

SEQ ID NO: 200565 - DNA, 353 bp, Homo sapiens
  misc_feature: GYAE6OF02FHSAC.18.17.B06.1.454.CMB.1.raw
  modified_base (350)..(353): a, c, t, g, unknown or other
  misc_feature (350)..(353): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgattgggccgcatgaacttccactttgactattggggccagggagccctggtcaccgtctcctcagcctccaccaagggcccatcggtcttcccctggcgccctgctccaggagcacctccgagagcacagcggcccctggctgcctggtcaaggactacttccatactcgtactgagcgggctggcaaggcgcatagnnnn

SEQ ID NO: 200566 - DNA, 356 bp, Homo sapiens
  misc_feature: GYAE6OF02FRNA4.18.17.B06.1.454.CMB.1.raw
  modified_base (352)..(356): a, c, t, g, unknown or other
  misc_feature (352)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaaggcccatcggtcttcccctggccgccctgctccaggagcacctccgagagcacagcggccctgggctgcctggtcaaggctacttcccatactcgtactgagcgggctggcaaggcgcatagnnnnn

SEQ ID NO: 200567 - DNA, 358 bp, Homo sapiens
  misc_feature: GYAE6OF02INIQ7.18.17.B06.1.454.CMB.1.raw
  modified_base (352)..(358): a, c, t, g, unknown or other
  misc_feature (352)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaggactacttcccatactcgtactgagcgggctggcaaggcgcatagnnnnnnn

SEQ ID NO: 200568 - DNA, 359 bp, Homo sapiens; identical to SEQ ID NO: 200444
  misc_feature: GYAE6OF02GXXL7.18.17.B06.1.454.CMB.1.raw
  modified_base (353)..(359): a, c, t, g, unknown or other
  misc_feature (353)..(359): n is a, c, g, or t

SEQ ID NO: 200569 - DNA, 356 bp, Homo sapiens
  misc_feature: GYAE6OF02ISDM6.18.17.B06.1.454.CMB.1.raw
  modified_base (353)..(356): a, c, t, g, unknown or other
  misc_feature (353)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtcttccccctggcgccctgctccaggagcacctctgggggcacagcggccctgggctgcctggtcaaggactacttcccatactcgtactgagcgggctggcaaggcgcatagnnnn

SEQ ID NO: 200570 - DNA, 360 bp, Homo sapiens
  misc_feature: GYAE6OF02JX7LP.18.17.B06.1.454.CMB.1.raw
  modified_base (351)..(360): a, c, t, g, unknown or other
  misc_feature (351)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaagctacttcccatactcgtactgagcgggctggcaaggcgcatagnnnnnnnnnn

SEQ ID NO: 200571 - DNA, 357 bp, Homo sapiens
  misc_feature: GYAE6OF02GUAOL.18.17.B06.1.454.CMB.1.raw
  modified_base (350)..(357): a, c, t, g, unknown or other
  misc_feature (350)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggctactcccatactcgtactgagcggctggcaaggcgcatagnnnnnnnn

SEQ ID NO: 200572 - DNA, 356 bp, Homo sapiens; identical to SEQ ID NO: 200549
  misc_feature: GYAE6OF02FJCLD.18.17.B06.1.454.CMB.1.raw
  modified_base (353)..(356): a, c, t, g, unknown or other
  misc_feature (353)..(356): n is a, c, g, or t

SEQ ID NO: 200573 - DNA, 384 bp, Homo sapiens
  misc_feature: GYAE6OF02IXQ7T.18.17.B06.1.454.CMB.1.raw
  modified_base (360)..(384): a, c, t, g, unknown or other
  misc_feature (360)..(384): n is a, c, g, or t
tcagtacgagtatgcacgaccggtgctcgatttagtcgatagtgaagggccggagttcaccatctccagagacaattccaagaacacggtgtcaatggaaatgaacagcctcgagagctgaggacacggctgtctatttctgtgcgaaggacacgatttggggccgcatgaacttccactttgactattggggccagggagccctggtcaccgtctcctcagcctccaccaaagggcccatcggtcttccccctaggcgccctgctccaggagcacctccgagagcacagcggcctgggctgcctggtcaaggactactcccagtacctcgtaactgagcgggctggcaaggcgcatagnnnnnnnnnnnnnnnnnnnnnnnnn

SEQ ID NO: 200574 - DNA, 359 bp, Homo sapiens
  misc_feature: GYAE6OF02JDEGU.18.17.B06.1.454.CMB.1.raw
  modified_base (354)..(359): a, c, t, g, unknown or other
  misc_feature (354)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagacgcacagcggccctgggctgcctggtcaaggctacttcccatactcgtactgagcgggctggcaaggcgcatagnnnnnn

SEQ ID NO: 200575 - DNA, 372 bp, Homo sapiens
  misc_feature: GYAE6OF02IK4OO.18.17.B06.1.454.CMB.1.raw
  modified_base (250)..(250): a, c, t, g, unknown or other
  misc_feature (250)..(250): n is a, c, g, or t
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (363)..(372): a, c, t, g, unknown or other
  misc_feature (363)..(372): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgtattggggccgcatgaacttccactttgactattggggccagggagcccctggtcaccgtctcctcagcctccaccaagggcccatcggcttcccccnggcgcccctgctccaggagcacctccgagagcacagcggtccctggggcctgcctggtaccaaggactacttcccatactcgtacngagcgggctggnaacggcgtcatagcnnnnnnnnnn

SEQ ID NO: 200576 - DNA, 358 bp, Homo sapiens
  misc_feature: GYAE6OF02HRY5H.18.17.B06.1.454.CMB.1.raw
  modified_base (346)..(346): a, c, t, g, unknown or other
  misc_feature (346)..(346): n is a, c, g, or t
  modified_base (352)..(358): a, c, t, g, unknown or other
  misc_feature (352)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggactacttcccatactcgtactgagcggctggcaaggcncatagnnnnnnn

SEQ ID NO: 200577 - DNA, 357 bp, Homo sapiens
  misc_feature: GYAE6OF02G0DEV.18.17.B06.1.454.CMB.1.raw
  modified_base (352)..(357): a, c, t, g, unknown or other
  misc_feature (352)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggctacttcccatactcgtactgagcgggctggcaaggcgcatagnnnnnn

SEQ ID NO: 200578 - DNA, 359 bp, Homo sapiens
  misc_feature: GYAE6OF02HC23L.18.17.B06.1.454.CMB.1.raw
  modified_base (355)..(359): a, c, t, g, unknown or other
  misc_feature (355)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagccggccctgggctgcctggtcaaggactacttcccatactcgtactgagcgggctggcaaggcgcatagnnnnn

SEQ ID NO: 200579 - DNA, 360 bp, Homo sapiens
  misc_feature: GYAE6OF02IS3EA.18.17.B06.1.454.CMB.1.raw
  modified_base (353)..(360): a, c, t, g, unknown or other
  misc_feature (353)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctacttcccatactcgtactgagcgggctggcaaggcgcatagnnnnnnnn

SEQ ID NO: 200580 - DNA, 357 bp, Homo sapiens; identical to SEQ ID NO: 200577
  misc_feature: GYAE6OF02GXAHJ.18.17.B06.1.454.CMB.1.raw
  modified_base (352)..(357): a, c, t, g, unknown or other
  misc_feature (352)..(357): n is a, c, g, or t

SEQ ID NO: 200581 - DNA, 358 bp, Homo sapiens
  misc_feature: GYAE6OF02GYOAJ.18.17.B06.1.454.CMB.1.raw
  modified_base (346)..(346): a, c, t, g, unknown or other
  misc_feature (346)..(346): n is a, c, g, or t
  modified_base (352)..(358): a, c, t, g, unknown or other
  misc_feature (352)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgattgggccgcatgaacttccactttgactattggggccagggagccctggtcaccgtctcctcagcctccaccaagggcccatcggtcttccccctggcgccctgctcccaggagcacctccgagagcacagcggccctgggctgcctggtcaaggctacttcccatactcgtactgagcgggctggcaaggcncatagnnnnnnn

SEQ ID NO: 200582 - DNA, 358 bp, Homo sapiens
  misc_feature: GYAE6OF02G11TA.18.17.B06.1.454.CMB.1.raw
  modified_base (353)..(358): a, c, t, g, unknown or other
  misc_feature (353)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactactcccatactcgtactgagcgggctggcaaggcgcatagnnnnnn

SEQ ID NO: 200583 - DNA, 357 bp, Homo sapiens; identical to SEQ ID NO: 200482
  misc_feature: GYAE6OF02HUHF9.18.17.B06.1.454.CMB.1.raw
  modified_base (353)..(357): a, c, t, g, unknown or other
  misc_feature (353)..(357): n is a, c, g, or t

SEQ ID NO: 200584 - DNA, 356 bp, Homo sapiens
  misc_feature: GYAE6OF02GYX82.18.17.B06.1.454.CMB.1.raw
  modified_base (351)..(356): a, c, t, g, unknown or other
  misc_feature (351)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggctacttcccatactcgtactgagcggctggcaaggcgcatagnnnnnn

SEQ ID NO: 200585 - DNA, 356 bp, Homo sapiens
  misc_feature: GYAE6OF02F2ZVD.18.17.B06.1.454.CMB.1.raw
  modified_base (351)..(356): a, c, t, g, unknown or other
  misc_feature (351)..(356): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggctactcccatactcgtactgagcgggctggcaaggcgcatagnnnnnn

SEQ ID NO: 200586 - DNA, 375 bp, Homo sapiens
  misc_feature: GYAE6OF02H9RMQ.18.17.B06.1.454.CMB.1.raw
  modified_base (348)..(348): a, c, t, g, unknown or other
  misc_feature (348)..(348): n is a, c, g, or t
  modified_base (354)..(375): a, c, t, g, unknown or other
  misc_feature (354)..(375): n is a, c, g, or t
tcagtacgagtatgcacgaccggtgctcgatttagtcgatagtgaagggccgattcaccatctccagagacaattccaaggaacacggtgtcaatggaaagtgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagacgcacagcggccctgggctgcctggtcaaggctacttccatactcgtactgagcgggctggcaaggcncatagnnnnnnnnnnnnnnnnnnnnnn

SEQ ID NO: 200587 - DNA, 358 bp, Homo sapiens
  misc_feature: GYAE6OF02GDS4E.18.17.B06.1.454.CMB.1.raw
  modified_base (353)..(358): a, c, t, g, unknown or other
  misc_feature (353)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtcttccccctggccgccctgctccaggagcacctccgagagcacagcggccctgggctgcctggtcaaggactactcccatactcgtactgagcgggctggcaaggcgcatagnnnnnn

SEQ ID NO: 200588 - DNA, 361 bp, Homo sapiens
  misc_feature: GYAE6OF02ID6R0.18.17.B06.1.454.CMB.1.raw
  modified_base (355)..(361): a, c, t, g, unknown or other
  misc_feature (355)..(361): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctgctccaggagcacctccgagagcacagcggccctgggctgcctggtcaaggactacttcccatactcgtactgagcgggctggcaaggcgcatagnnnnnnn

SEQ ID NO: 200589 - DNA, 361 bp, Homo sapiens
  misc_feature: GYAE6OF02I0IKD.18.17.B06.1.454.CMB.1.raw
  modified_base (354)..(361): a, c, t, g, unknown or other
  misc_feature (354)..(361): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactacttcccatactcgtactgagcgggctggcaaggcgcatagnnnnnnnn

SEQ ID NO: 200590 - DNA, 357 bp, Homo sapiens
  misc_feature: GYAE6OF02GDWRH.18.17.B06.1.454.CMB.1.raw
  modified_base (352)..(357): a, c, t, g, unknown or other
  misc_feature (352)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttgggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactactcccatactcgtactgagcgggctggcaaggcgcatagnnnnnn

SEQ ID NO: 200591 - DNA, 366 bp, Homo sapiens
  misc_feature: GYAE6OF02I6H89.18.17.B06.1.454.CMB.1.raw
  modified_base (359)..(366): a, c, t, g, unknown or other
  misc_feature (359)..(366): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgcccctgcctccaggacgccacctccggagacgcacagcggccctgggctgcctggtcaaggactactccatactcgtactgagcggctggcaaggcgcatgnnnnnnnn

SEQ ID NO: 200592 - DNA, 351 bp, Homo sapiens
  misc_feature: GYAE6OF02GBISI.18.17.B06.1.454.CMB.1.raw
  modified_base (349)..(351): a, c, t, g, unknown or other
  misc_feature (349)..(351): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctactccatactcgtactgagcggctggcaggcgcatagnnn

SEQ ID NO: 200593 - DNA, 358 bp, Homo sapiens
  misc_feature: GYAE6OF02FWXAK.18.17.B06.1.454.CMB.1.raw
  modified_base (352)..(358): a, c, t, g, unknown or other
  misc_feature (352)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactactccctactcgtactgagcgggctggcaaggcgcatagnnnnnnn

SEQ ID NO: 200594 - DNA, 357 bp, Homo sapiens
  misc_feature: GYAE6OF02IAC7P.18.17.B06.1.454.CMB.1.raw
  modified_base (353)..(357): a, c, t, g, unknown or other
  misc_feature (353)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcttccaccaagggcccatcggtcttcccctggcgccctgctccaggagcacctctgggggcacagcggccctgggctgccctggtcaaggactacttccatactcgtactgagcgggctggcaaggcgcatagnnnnn

SEQ ID NO: 200595 - DNA, 363 bp, Homo sapiens
  misc_feature: GYAE6OF02IOW4T.18.17.B06.1.454.CMB.1.raw
  modified_base (353)..(363): a, c, t, g, unknown or other
  misc_feature (353)..(363): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggactactcccatactcgtactgagcgggctggcaaggcgcatagnnnnnnnnnnn

SEQ ID NO: 200596 - DNA, 361 bp, Homo sapiens
  misc_feature: GYAE6OF02GPIRC.18.17.B06.1.454.CMB.1.raw
  modified_base (352)..(361): a, c, t, g, unknown or other
  misc_feature (352)..(361): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctggctgcctggtcaaggactacttccatactcgtactgagcgggctggcaaggcgcatagnnnnnnnnnn

SEQ ID NO: 200597 - DNA, 366 bp, Homo sapiens
  misc_feature: GYAE6OF02IPZWU.18.17.B06.1.454.CMB.1.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (339)..(339): a, c, t, g, unknown or other
  misc_feature (339)..(339): n is a, c, g, or t
  modified_base (356)..(366): a, c, t, g, unknown or other
  misc_feature (356)..(366): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggactacgattttggggccgtctatgaactttccacttttgactattggggccagggagccctggtcaccgtctcctcagcctccaccagggccatcgtctccccnggcncctgctccaggagcacctccgagagtcacagcggccctgggctgccgtggtcaaggactactcccgatactcgtactgagcggntggcaaggcgcataagnnnnnnnnnnn

SEQ ID NO: 200598 - DNA, 358 bp, Homo sapiens
  misc_feature: GYAE6OF02HX0WL.18.17.B06.1.454.CMB.1.raw
  modified_base (266)..(266): a, c, t, g, unknown or other
  misc_feature (266)..(266): n is a, c, g, or t
  modified_base (278)..(278): a, c, t, g, unknown or other
  misc_feature (278)..(278): n is a, c, g, or t
  modified_base (344)..(344): a, c, t, g, unknown or other
  misc_feature (344)..(344): n is a, c, g, or t
  modified_base (350)..(358): a, c, t, g, unknown or other
  misc_feature (350)..(358): n is a, c, g, or t
tcagtacgagtatgcacgaccggtgctcgatttagtcgatagtgaagggccgattcaccatctccagagacaattccaataacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggngcacctccgagngcacagcggccctggctgcctggtcaaggctacttcccatactcgtactgagcggctggcaaggcncatagnnnnnnnnn

SEQ ID NO: 200599 - DNA, 358 bp, Homo sapiens
  misc_feature: GYAE6OF02GM0YS.18.17.B06.1.454.CMB.1.raw
  modified_base (352)..(358): a, c, t, g, unknown or other
  misc_feature (352)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctccgagagcacagcggccctgggctgcctggtcaaggactactcccatactcgtactgagcgggctggcaaggcgcatagnnnnnnn

SEQ ID NO: 200600 - DNA, 358 bp, Homo sapiens
  misc_feature: GYAE6OF02HI3AV.18.17.B06.1.454.CMB.1.raw
  modified_base (352)..(358): a, c, t, g, unknown or other
  misc_feature (352)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaaggctactcccatactcgtactgagcgggctggcaaggcgcatagnnnnnnn

SEQ ID NO: 200601 - DNA, 393 bp, Homo sapiens
  misc_feature: GYAE6OF02I26WR.18.17.B06.1.454.CMB.1.raw
  modified_base (258)..(258): a, c, t, g, unknown or other
  misc_feature (258)..(258): n is a, c, g, or t
  modified_base (356)..(393): a, c, t, g, unknown or other
  misc_feature (356)..(393): n is a, c, g, or t
tcagtacgagtatgcacgaccggtgctcgatttagtcgatagtgaagggccggaagttcgaccatctccagagacaattccaagaacacggtgtcaatggaaatgaacagcctcgagagctgaggacacggctgtctatttctgtgcgaaggacacgatttggggccgcatgaacttccactttgactattggggccagggagccctggtcaccgtctcctcagcctcaccaagggcccatcggtcttccccctggcncctgctccaggagcacctccgagagcacagcggccctgggctgcctggtcaaggctacttccatactcgtactgagcgggctggcaaggcgcatacgnnnnnnnnnnnnnnnnnnnnnnnnnnnnnnnnnnnnnn

SEQ ID NO: 200602 - DNA, 368 bp, Homo sapiens
  misc_feature: GYAE6OF02H7ZO7.18.17.B06.1.454.CMB.1.raw
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
  modified_base (355)..(368): a, c, t, g, unknown or other
  misc_feature (355)..(368): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcnccctgctccaggagcacctccgagngcacagcggccctgggctgcctggtcaaggactacttcccatacctcgtactgagcgggctggcaaggcgcagtagnnnnnnnnnnnnnn

SEQ ID NO: 200603 - DNA, 358 bp, Homo sapiens; identical to SEQ ID NO: 200599
  misc_feature: GYAE6OF02IA3UG.18.17.B06.1.454.CMB.1.raw
  modified_base (352)..(358): a, c, t, g, unknown or other
  misc_feature (352)..(358): n is a, c, g, or t

SEQ ID NO: 200604 - DNA, 358 bp, Homo sapiens
  misc_feature: GYAE6OF02H8VHN.18.17.B06.1.454.CMB.1.raw
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (350)..(358): a, c, t, g, unknown or other
  misc_feature (350)..(358): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcgccctgctccaggagcacctcgagngcacngcgcctgggctgcctggtcaaggctacttcccatactcgtactgagcgggctggcaacggcgcatagnnnnnnnnn

SEQ ID NO: 200605 - DNA, 353 bp, Homo sapiens
  misc_feature: GYAE6OF02I4ULI.18.17.B06.1.454.CMB.1.raw
  modified_base (349)..(353): a, c, t, g, unknown or other
  misc_feature (349)..(353): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtctccccctggccgccctgctccaggagcacctccgagagcacagcggccctgggctgcctggtcaaggctactccatactcgtactgagcgggctggcaggcgcatgnnnnn

SEQ ID NO: 200606 - DNA, 357 bp, Homo sapiens
  misc_feature: GYAE6OF02GY1CF.18.17.B06.1.454.CMB.1.raw
  modified_base (352)..(357): a, c, t, g, unknown or other
  misc_feature (352)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgccctgctccaggagcacctccgagagcacagcggccctgggctgcctggtcaggactacttcccatactcgtactgagcggctggcaaggcgcatagnnnnnn

SEQ ID NO: 200607 - DNA, 486 bp, Homo sapiens
  misc_feature: GYAE6OF02G9BGU.18.17.B06.1.454.CMB.1.raw
  modified_base (400)..(403): a, c, t, g, unknown or other
  misc_feature (400)..(403): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (417)..(418): a, c, t, g, unknown or other
  misc_feature (417)..(418): n is a, c, g, or t
  modified_base (420)..(421): a, c, t, g, unknown or other
  misc_feature (420)..(421): n is a, c, g, or t
  modified_base (423)..(427): a, c, t, g, unknown or other
  misc_feature (423)..(427): n is a, c, g, or t
  modified_base (429)..(429): a, c, t, g, unknown or other
  misc_feature (429)..(429): n is a, c, g, or t
  modified_base (431)..(432): a, c, t, g, unknown or other
  misc_feature (431)..(432): n is a, c, g, or t
  modified_base (436)..(436): a, c, t, g, unknown or other
  misc_feature (436)..(436): n is a, c, g, or t
  modified_base (438)..(440): a, c, t, g, unknown or other
  misc_feature (438)..(440): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (471)..(480): a, c, t, g, unknown or other
  misc_feature (471)..(480): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
tcagtacgagtatgcacgaccggtgctcgatttagtcgatagtgaaggggaccgggattcaccactctccagagacaattccaagaacacggtgtcaaagtcggaaatgaacagccctggagacgctgaggacacggctgtcctaagtttctcgtgcgaaggacacgatttggggccgcatcgaacttccactttcgacctattggggccagggagcctggtcaccgtactcctcagcctccaccaacgggcccaatcggtcttccccctggacgaccctgcttccacggagtcacctccgagaacgcgaacacgacggccctgggctgcctggtcaaggctactccatacttcgtaactgagccgggctggacaaggtccgacacgtacgatcgatcgnnnnctcacnctcncagnncnncnnnnntntnntatntnnnantntctctctcncgtcgcgcgcgngngngnnnnnnnnnncncntn

SEQ ID NO: 200608 - DNA, 357 bp, Homo sapiens
  misc_feature: GYAE6OF02GFGS2.18.17.B06.1.454.CMB.1.raw
  modified_base (266)..(266): a, c, t, g, unknown or other
  misc_feature (266)..(266): n is a, c, g, or t
  modified_base (354)..(357): a, c, t, g, unknown or other
  misc_feature (354)..(357): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtctccccctggcgccctgctccaggngcacctccgagagcacagcggccctgggcctgcctggtcaaggactacttcccatactcgtactgagcgggctggcaaggcgcatagnnnn

SEQ ID NO: 200609 - DNA, 373 bp, Homo sapiens
  misc_feature: GYAE6OF02HVR8M.18.17.B06.1.454.CMB.1.raw
  modified_base (279)..(279): a, c, t, g, unknown or other
  misc_feature (279)..(279): n is a, c, g, or t
  modified_base (354)..(373): a, c, t, g, unknown or other
  misc_feature (354)..(373): n is a, c, g, or t
tcagtacgagtatgcacgaccggtgctcgatttagtcgatagtgaagggccgagttcgccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtcttccccctggcgccctgctccaggagcacctccgagngcacagcggccctgggctgcctggtcaaggctacttcccatactcgtactgacgcgggctggcaaggcgcatagnnnnnnnnnnnnnnnnnnnn

SEQ ID NO: 200610 - DNA, 385 bp, Homo sapiens
  misc_feature: GYAE6OF02GTA6N.18.17.B06.1.454.CMB.1.raw
  modified_base (270)..(270): a, c, t, g, unknown or other
  misc_feature (270)..(270): n is a, c, g, or t
  modified_base (370)..(370): a, c, t, g, unknown or other
  misc_feature (370)..(370): n is a, c, g, or t
  modified_base (373)..(385): a, c, t, g, unknown or other
  misc_feature (373)..(385): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacgactgtctatttctgtgcgaaggacacgatttggggccgcatgaacttccactttgactattggggccagggagccctggtcaccgtctcctcagcctccaccaagggcccatcggtcttccccctggccgccctgctccaggacncacctccgagagcacacgcggccctggggactgccgtggtccgaaggacctaccttcccatacctcgtacctgacggtcgggctggcaacggcgcatagnagnnnnnnnnnnnnn

SEQ ID NO: 200611 - DNA, 363 bp, Homo sapiens
  misc_feature: GYAE6OF02GBICK.18.17.B06.1.454.CMB.1.raw
  modified_base (354)..(363): a, c, t, g, unknown or other
  misc_feature (354)..(363): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctgctccaggagcacctccgagacgcacagcggccctgggctgcctggtcaaggactactccatactcgtactgagcgggctggcaaggcgcatagnnnnnnnnnn

SEQ ID NO: 200612 - DNA, 463 bp, Homo sapiens
  misc_feature: GYAE6OF02JC3V4.18.17.B06.1.454.CMB.1.raw
  modified_base (164)..(164): a, c, t, g, unknown or other
  misc_feature (164)..(164): n is a, c, g, or t
  modified_base (264)..(264): a, c, t, g, unknown or other
  misc_feature (264)..(264): n is a, c, g, or t
  modified_base (331)..(331): a, c, t, g, unknown or other
  misc_feature (331)..(331): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (409)..(463): a, c, t, g, unknown or other
  misc_feature (409)..(463): n is a, c, g, or t
tcagtacgagtatgcacgaccggtgctcgatttagtcgatagtgaagggccgagttcaccatctccagagacaattccaagaacacggtgtcaatggaaatgaacagcctgagagctgaggacacggctgtctatttctgtgcgaaggacacgatttggggccnatgaacttccactttgactattgggccagggagccctggtcaaccgtctcctcaacgtccaccaacgaaccggacctacggtccgtttccccttccccgnggccctccgtcgccttaccggaggcacctaccctccgaggactcaaacgcggccgtccggtcggtcncgtccgtgtaacgaaggtacctacctccaatccgtacttanaggacgtcggtcgngacgacggaccngtaanaggcannnnnnnnnnnnnnnnnnnnnnnnnnnnnnnnnnnnnnnnnnnnnnnnnnnnnnn

SEQ ID NO: 200613 - DNA, 355 bp, Homo sapiens
  misc_feature: GYAE6OF02FMORI.18.17.B06.1.454.CMB.1.raw
  modified_base (352)..(355): a, c, t, g, unknown or other
  misc_feature (352)..(355): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgattggggccgcatgaacttccactttgactattggggccagggagccctggtcaccgtctcctcagcctccaccaagggcccatcggtcttccccctggccgccctgctcccaggagcacctccgagagcacagcggccctgggctgcctggtcaaggctactcccatactcgtactgagcggctggcaaggcgcatagnnnn

SEQ ID NO: 200614 - DNA, 423 bp, Homo sapiens
  misc_feature: GYAE6OF02JF7WC.18.17.B06.1.454.CMB.1.raw
  modified_base (329)..(329): a, c, t, g, unknown or other
  misc_feature (329)..(329): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (404)..(411): a, c, t, g, unknown or other
  misc_feature (404)..(411): n is a, c, g, or t
  modified_base (414)..(423): a, c, t, g, unknown or other
  misc_feature (414)..(423): n is a, c, g, or t
tcagtacgagtatgcacgaccggtgctcgatttagtcgatagtgaagggccggattcaccatctccagagacaattccaagaacacggtgtcaatggaaatgaacagcctgagagctgaggacacggcgtgtctatttctgtgcgaaggacacgatttggggccgcatgacttccactttgactattggggccagggctcccgtggtccaccgtctcctcagcctccaccgaacgggcccagtccggtccttccccctggccgccccttgcctcccgaggaccgccaacctccggaagacgcacgacggccgtcccgtgggcctggccnggttacaacggaccttcctccccgatacctcgtactaggcgccggggctgggaccaacggcgaccagtagncngnnnnnnnntannnnnnnnnn

SEQ ID NO: 200615 - DNA, 374 bp, Homo sapiens
  misc_feature: GYAE6OF02JGY22.18.17.B06.1.454.CMB.1.raw
  modified_base (359)..(374): a, c, t, g, unknown or other
  misc_feature (359)..(374): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctgcctccaggacgcaccgtccgagagcacagcggccctgggcctgcctggtcaaggactactcccatactcgtactgagcgggctggcaaggcgcatagcnnnnnnnnnnnnnnnn

SEQ ID NO: 200616 - DNA, 372 bp, Homo sapiens
  misc_feature: GYAE6OF02IVDL7.18.17.B06.1.454.CMB.1.raw
  modified_base (267)..(267): a, c, t, g, unknown or other
  misc_feature (267)..(267): n is a, c, g, or t
  modified_base (357)..(372): a, c, t, g, unknown or other
  misc_feature (357)..(372): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtctccccctggccgccctgctccaggncacctccgagagcacagcggccctgggctcgcctggtcaaggacctacttcccatactcgtactgacgcgggctggcaacggcacatagnnnnnnnnnnnnnnnn

SEQ ID NO: 200617 - DNA, 384 bp, Homo sapiens
  misc_feature: GYAE6OF02GNIWU.18.17.B06.1.454.CMB.1.raw
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (363)..(384): a, c, t, g, unknown or other
  misc_feature (363)..(384): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctgctccaggancacctccgagngcacagccgccctgggctgcctggtcaaggcctactcccatactcgtactgacgcgggctgggcaacggcncagtagngncgnnnnnnnnnnnnnnnnnnnnnn

SEQ ID NO: 200618 - DNA, 364 bp, Homo sapiens
  misc_feature: GYAE6OF02G6FQI.18.17.B06.1.454.CMB.1.raw
  modified_base (270)..(270): a, c, t, g, unknown or other
  misc_feature (270)..(270): n is a, c, g, or t
  modified_base (358)..(364): a, c, t, g, unknown or other
  misc_feature (358)..(364): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtccttccccctggccgccctgctccaggancacctccgagagcacagcggccctgggcctgcctggtcaaggacctacttcccatactcgtactgagcgggctggcaaggcgcatagnnnnnnn

SEQ ID NO: 200619 - DNA, 364 bp, Homo sapiens
  misc_feature: GYAE6OF02F8HM7.18.17.B06.1.454.CMB.1.raw
  modified_base (356)..(364): a, c, t, g, unknown or other
  misc_feature (356)..(364): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcttccaccaagggcccatcggtcttccccctggccgccctgctccaggagcacctctgggggcacagcggccctgggctgccctggtcaaggactacttcccatactcgtactgagcgggctggcaaggcgcatagnnnnnnnnn

SEQ ID NO: 200620 - DNA, 407 bp, Homo sapiens
  misc_feature: GYAE6OF02GF1M0.18.17.B06.1.454.CMB.1.raw
  modified_base (261)..(261): a, c, t, g, unknown or other
  misc_feature (261)..(261): n is a, c, g, or t
  modified_base (377)..(377): a, c, t, g, unknown or other
  misc_feature (377)..(377): n is a, c, g, or t
  modified_base (383)..(407): a, c, t, g, unknown or other
  misc_feature (383)..(407): n is a, c, g, or t
tcagtacgagtatgcacgaccggtgctcgatttagtcgatagtgaagggccggattcaccatctccagagacaattccaagaacacggtgtcaatggaaatgaacagcctgagagctgaggacacggctgtctatttctgtgcgaaggacacgtatttgggccgcattgaacttccactttgactattggggccagggagccctggtcaccgtctccgtcacgcctccaccacgggcccatccggtcttccccctggcccnccctgctcccaggtacgccaccctccgagacgcacacggcggcccctgggcctcggcctgggtccaagggtctacgttcccagttaccgtcggtactgagcggtctgggcaaggcncagtgnnnnnnnnnnnnnnnnnnnnnnnnn

SEQ ID NO: 200621 - DNA, 360 bp, Homo sapiens
  misc_feature: GYAE6OF02HGV5O.18.17.B06.1.454.CMB.1.raw
  modified_base (250)..(250): a, c, t, g, unknown or other
  misc_feature (250)..(250): n is a, c, g, or t
  modified_base (349)..(349): a, c, t, g, unknown or other
  misc_feature (349)..(349): n is a, c, g, or t
  modified_base (355)..(360): a, c, t, g, unknown or other
  misc_feature (355)..(360): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccccnggccgccctgctccaggagcacctccgagagcacagcggccctgggctgcctggtcaaggacctactcccatactcgtactgagcgggctggcaaggcncatagnnnnnn

SEQ ID NO: 200622 - DNA, 363 bp, Homo sapiens
  misc_feature: GYAE6OF02H0KC7.18.17.B06.1.454.CMB.1.raw
  modified_base (354)..(363): a, c, t, g, unknown or other
  misc_feature (354)..(363): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccacgggccatccggtcttcccctggccgccctgcctccaggcgcaccctcgagagcacagccgcctgggctgcctggtcaaggactaccttccatctcgtactgagcgggctggcaaggcgcagtagnnnnnnnnnn

SEQ ID NO: 200623 - DNA, 379 bp, Homo sapiens
  misc_feature: GYAE6OF02I7VYE.18.17.B06.1.454.CMB.1.raw
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (363)..(379): a, c, t, g, unknown or other
  misc_feature (363)..(379): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtccttccccctggccgcccctgctcccaggagccacctccgagagcacagcggccctgggctgccgtggtcgaacggctactccatactcgtacngacgcgggctggcaaggcgacatagngnnnnnnnnnnnnnnnnn

SEQ ID NO: 200624 - DNA, 384 bp, Homo sapiens
  misc_feature: GYAE6OF02FUOD1.18.17.B06.1.454.CMB.1.raw
  modified_base (355)..(355): a, c, t, g, unknown or other
  misc_feature (355)..(355): n is a, c, g, or t
  modified_base (362)..(384): a, c, t, g, unknown or other
  misc_feature (362)..(384): n is a, c, g, or t
tcagtacgagtatgcacgaccggtgctcgatttagtcgatagtgaagggccgagttcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggccccatccggtccttcccccgtggccgccctgcctccaggagcacctccgagacgcacagcggccctgggcctgcctggtcaaggcctactcccatactcgtactgagcgggctggcaggcncagtcgnnnnnnnnnnnnnnnnnnnnnnn

SEQ ID NO: 200625 - DNA, 370 bp, Homo sapiens
  misc_feature: GYAE6OF02ICVC1.18.17.B06.1.454.CMB.1.raw
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (361)..(370): a, c, t, g, unknown or other
  misc_feature (361)..(370): n is a, c, g, or t
tcagtacgagtatgcacgaccggtgctcgatttagtcgatagtgaagggccgattcaccatctccagagacaattccaagaacacggtctatctacaaatgaacagcctgagagccgaggacacggccctgtatttctgtgtgagagatcgaaaattccctttcgatgttcttgatatgtggggccaagggacaatggtcaccgtctcctcacgcctccaccaagggcccatcggtccttccccctggccgccctgcctccaggagccacctccgagacgcaccagccggcccctggggcctgccctgggtcaaggcctacttcccatctcgtacngaggcgggctggcaaggcgnatagnnnnnnnnnn

SEQ ID NO: 200626 - DNA, 362 bp, Homo sapiens
  misc_feature: GYAE6OF02H0X7R.18.17.B06.1.454.CMB.1.raw
  modified_base (266)..(266): a, c, t, g, unknown or other
  misc_feature (266)..(266): n is a, c, g, or t
  modified_base (348)..(348): a, c, t, g, unknown or other
  misc_feature (348)..(348): n is a, c, g, or t
  modified_base (353)..(362): a, c, t, g, unknown or other
  misc_feature (353)..(362): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggagacggctgtctatttctgtgcgaaggacacgatttggggccgcatgaacttccactttgactattggggccagggagccctggtcaccgtctcctcagcctccaccaagggcccatcggtcttcccctggcgccctgctccaggngcacctccgagagcacagccggccctgggctgcctggtcaaggcttacttcccatactcgtactgagcggctggcaaggcgnatagnnnnnnnnnn

SEQ ID NO: 200627 - DNA, 368 bp, Homo sapiens
  misc_feature: GYAE6OF02HVSUI.18.17.B06.1.454.CMB.1.raw
  modified_base (353)..(368): a, c, t, g, unknown or other
  misc_feature (353)..(368): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtccttccccctggcgccctgctccaggagcacctccgagagcacagcggccctgggctgcctggtcaaggctacttccatactcgtactgagcggctggacaaggcgacatagnnnnnnnnnnnnnnnn

SEQ ID NO: 200628 - DNA, 366 bp, Homo sapiens
  misc_feature: GYAE6OF02INO2K.18.17.B06.1.454.CMB.1.raw
  modified_base (359)..(366): a, c, t, g, unknown or other
  misc_feature (359)..(366): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgccctgcctccgaggagccacctccgagagcacagcgccctgggctgcctggtcaaggactacttcccatactcgtactgacgcggctggcaaggcgcatagnnnnnnnn

SEQ ID NO: 200629 - DNA, 359 bp, Homo sapiens
  misc_feature: GYAE6OF02GZKVY.18.17.B06.1.454.CMB.1.raw
  modified_base (353)..(359): a, c, t, g, unknown or other
  misc_feature (353)..(359): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtcttcccctggcgccctcgctccaggagcacctccgagagcacagcggccctgggctgcctggtcaaggactacttcccatactcgtactgagcgggctggcaaggcgcatagnnnnnnn

SEQ ID NO: 200630 - DNA, 372 bp, Homo sapiens
  misc_feature: GYAE6OF02FK1DO.18.17.B06.1.454.CMB.1.raw
  modified_base (338)..(338): a, c, t, g, unknown or other
  misc_feature (338)..(338): n is a, c, g, or t
  modified_base (357)..(372): a, c, t, g, unknown or other
  misc_feature (357)..(372): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggcgcccctgctccaggagcacctccgagagcacagcggccctgggctgcctggtcaaggactactcccatactcgtactgagcgggntcggcaaaggcgcataggnnnnnnnnnnnnnnnn

SEQ ID NO: 200631 - DNA, 362 bp, Homo sapiens
  misc_feature: GYAE6OF02GN9OI.18.17.B06.1.454.CMB.1.raw
  modified_base (253)..(253): a, c, t, g, unknown or other
  misc_feature (253)..(253): n is a, c, g, or t
  modified_base (354)..(362): a, c, t, g, unknown or other
  misc_feature (354)..(362): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttcccctggcnccctgcctccaggacgcacctccgagagcacagccggccctgggctgcctggtcaaggactactccatactcgtactgagcgggctggcaaggcgcatagnnnnnnnnn

SEQ ID NO: 200632 - DNA, 515 bp, Homo sapiens
  misc_feature: GYAE6OF02GRFYE.18.17.B06.1.454.CMB.1.raw
  modified_base (464)..(464): a, c, t, g, unknown or other
  misc_feature (464)..(464): n is a, c, g, or t
  modified_base (467)..(468): a, c, t, g, unknown or other
  misc_feature (467)..(468): n is a, c, g, or t
  modified_base (471)..(515): a, c, t, g, unknown or other
  misc_feature (471)..(515): n is a, c, g, or t
tcagtacgagtatgcacgaccggtgctcgatttagtcgatagtgaagggccgagttcaccatctccagagacaattccaagaacacggtgtcaatggaaatgaacagcctgagagctgaggacacggctgtctatttctgtgcgaaggacacgtagtttgggggccgcatcgaacctttccactttgacttagttgggggccaggggcgcccgtggtccaccgtctcctcacgccctccaaccgaagggccctagttccggtcccttccccccgtgggcccgcccctcggccttacccgacgggacgtccacccgtccggaagacgccacgacggcccgggtccccgtgggggcctacggtcccggtagggtaccgaaacgggtacctacccgtttaccaacgttacccgtcggttacgtaggacggcccggggacttgggaccgtaacgggcgacaagtagcngannacnnnnnnnnnnnnnnnnnnnnnnnnnnnnnnnnnnnnnnnnnnnnn

SEQ ID NO: 200633 - DNA, 367 bp, Homo sapiens
  misc_feature: GYAE6OF02GLSDK.18.17.B06.1.454.CMB.1.raw
  modified_base (354)..(367): a, c, t, g, unknown or other
  misc_feature (354)..(367): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtcttccccctggccgccctgctccaggagcacctccgagagcacagcggccctgggctgcctggtcaaggctactcccatactcgtactgagcggggctggcaaggcgcatagnnnnnnnnnnnnnn

SEQ ID NO: 200634 - DNA, 355 bp, Homo sapiens
  misc_feature: GYAE6OF02INPUY.18.17.B06.1.454.CMB.1.raw
  modified_base (265)..(265): a, c, t, g, unknown or other
  misc_feature (265)..(265): n is a, c, g, or t
  modified_base (325)..(325): a, c, t, g, unknown or other
  misc_feature (325)..(325): n is a, c, g, or t
  modified_base (347)..(355): a, c, t, g, unknown or other
  misc_feature (347)..(355): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctcaccaaggcccatccgtccttcccctggcgccctgctccaggngcacctccgagagcacagcggccctgggctgcctggtcaaggctactcccatctcgtacngagcggctggcaaggcacatgnnnnnnnnn

SEQ ID NO: 200635 - DNA, 496 bp, Homo sapiens
  misc_feature: GYAE6OF02IWUO8.18.17.B06.1.454.CMB.1.raw
  modified_base (442)..(496): a, c, t, g, unknown or other
  misc_feature (442)..(496): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccacttttgacttattggggccagggagccctggtcaccgtctcctcagcctccaccaaggccccatccggtccttccccctggccgccctgcctccgaggacgccacccgtccgagagccacaggccggccccgtggggcctcggcccgttggggtaccgaaacgggtacccttaacccgttccccaacgttaacccgttccggtaacttcggacgggccgggggtccgtcgggaccgtaaagggccgaacctaagtacggcagctgcnnnnnnnnnnnnnnnnnnnnnnnnnnnnnnnnnnnnnnnnnnnnnnnnnnnnnnn

SEQ ID NO: 200636 - DNA, 385 bp, Homo sapiens
  misc_feature: GYAE6OF02H6C6C.18.17.B06.1.454.CMB.1.raw
  modified_base (367)..(367): a, c, t, g, unknown or other
  misc_feature (367)..(367): n is a, c, g, or t
  modified_base (372)..(385): a, c, t, g, unknown or other
  misc_feature (372)..(385): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccgagggcccagtcggtccttccccctggccgccctgcctccgaggacgccacctcccgagacgcacgagccggccccgtgggctcggcctggtacaaggactaccttcccataccttcgtactgagcggctggcaggcganatagnnnnnnnnnnnnnn

SEQ ID NO: 200637 - DNA, 404 bp, Homo sapiens
  misc_feature: GYAE6OF02JEXA8.18.17.B06.1.454.CMB.1.raw
  modified_base (279)..(279): a, c, t, g, unknown or other
  misc_feature (279)..(279): n is a, c, g, or t
  modified_base (367)..(368): a, c, t, g, unknown or other
  misc_feature (367)..(368): n is a, c, g, or t
  modified_base (370)..(404): a, c, t, g, unknown or other
  misc_feature (370)..(404): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagcccctggtcaccgtctcctcagcctccaccaagggcccatcggtcttccccctggcgccctgctccatgagcacctccganacgcacagcggccctgggcctgcctggtcaaggctaacttcccagtacctctactgacgcgggtactggacaagggccacgataaggnngnnnnnnnnnnnnnnnnnnnnnnnnnnnnnnnnnnn

SEQ ID NO: 200638 - DNA, 353 bp, Homo sapiens
  misc_feature: GYAE6OF02II8J9.18.17.B06.1.454.CMB.1.raw
  modified_base (348)..(353): a, c, t, g, unknown or other
  misc_feature (348)..(353): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattgggccagggagccctggtcaccgtctcctcagcctccaccaaggcccatcggtcttccccctgcaccctcctcaagagcacctctgggggcacagcggccctggctgcctggtcaaggctactcccataactcgtactgacgcggctggcaaggcgcatagnnnnnn

SEQ ID NO: 200639 - DNA, 367 bp, Homo sapiens
  misc_feature: GYAE6OF02ITKCS.18.17.B06.1.454.CMB.1.raw
  modified_base (357)..(367): a, c, t, g, unknown or other
  misc_feature (357)..(367): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtctcccctggcgccctgctccaggacgcacctccgagacgcacagtcggcctgggctcgcctggtcaacggactaccttccatactcgtactgacgcggctggcaacggcgacatagnnnnnnnnnnn

SEQ ID NO: 200640 - DNA, 424 bp, Homo sapiens
  misc_feature: GYAE6OF02J1P76.18.17.B06.1.454.CMB.1.raw
  modified_base (399)..(399): a, c, t, g, unknown or other
  misc_feature (399)..(399): n is a, c, g, or t
  modified_base (401)..(424): a, c, t, g, unknown or other
  misc_feature (401)..(424): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgattggggccgcatgaacttccactttgactattggggccagggagccctggtcaccgtctcctcagcctccaccaagggcccatccggtccttccccctggccgcccctgcctccaggacgcaccctccgagacgcacgacgccggcccctgggcctcggccgtcggtacaacgggacctaccttccccgataccttccgtaactcggacggccggggtctcggacgaacgggaccgccaatacggngnnnnnnnnnnnnnnnnnnnnnnnn

SEQ ID NO: 200641 - DNA, 376 bp, Homo sapiens
  misc_feature: GYAE6OF02JCGGU.18.17.B06.1.454.CMB.1.raw
  modified_base (260)..(260): a, c, t, g, unknown or other
  misc_feature (260)..(260): n is a, c, g, or t
  modified_base (357)..(376): a, c, t, g, unknown or other
  misc_feature (357)..(376): n is a, c, g, or t
tcagtacgagtatgcacgaccggtgctcgatttagtcgatagtgaagggccgattcaccatctccagagacaattccaagaacacggtgtcaatggaaatgaacagcctgagagctgagggacacggctgtctatttctgtgcgaaggacacgatttggggccgcatgaacttccactttgactattggggccagggagccctggtcaccgtctcctcagcctccaccaagggcccatcggtcttccccctggcgccctnctccaggagcacctccgagagcacagcggccctgggctgcctggtcaaggctacttcccatctcgtactgagcgggctgggacaaggcgcatagagnnnnnnnnnnnnnnnnnnnn

SEQ ID NO: 200642 - DNA, 368 bp, Homo sapiens
  misc_feature: GYAE6OF02HM3Y7.18.17.B06.1.454.CMB.1.raw
  modified_base (272)..(272): a, c, t, g, unknown or other
  misc_feature (272)..(272): n is a, c, g, or t
  modified_base (360)..(368): a, c, t, g, unknown or other
  misc_feature (360)..(368): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttgggggccgcatgaacttccactttgactattggggccagggagccctggtcaccgtctcctcagcctccaccaaggcccatccggtccttccccctggccgcccctgcctccaggngcacctcgagagcacagcggccctgggctgcctggtcaaggactacttcccatacctcgtactgagcgggctggcaaggcgacatagnnnnnnnnn

SEQ ID NO: 200643 - DNA, 369 bp, Homo sapiens
  misc_feature: GYAE6OF02G1PO6.18.17.B06.1.454.CMB.1.raw
  modified_base (271)..(271): a, c, t, g, unknown or other
  misc_feature (271)..(271): n is a, c, g, or t
  modified_base (358)..(369): a, c, t, g, unknown or other
  misc_feature (358)..(369): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatcggtccttccccctggccgccctgcctccaggcnccaccctcgagagcacgagccggccctgggctgcctggtcaggctacttccatctcgtactgagcgggctggacaaggcgcagtagnnnnnnnnnnnn

SEQ ID NO: 200644 - DNA, 405 bp, Homo sapiens
  misc_feature: GYAE6OF02GX5FS.18.17.B06.1.454.CMB.1.raw
  modified_base (373)..(373): a, c, t, g, unknown or other
  misc_feature (373)..(373): n is a, c, g, or t
  modified_base (380)..(405): a, c, t, g, unknown or other
  misc_feature (380)..(405): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattgggccagggagccctggtcaccgtctcctcagcctccaccgaagggcccatccggtccttccccctggccgccctgctccaggagccacctccgagacgccacaggccggccctgggcctggccgtggtacaacggaccttaccttccccattacctcgtactggacgcggctggacgaaggccganagtacgnnnnnnnnnnnnnnnnnnnnnnnnnn

SEQ ID NO: 200645 - DNA, 445 bp, Homo sapiens
  misc_feature: GYAE6OF02I1FV8.18.17.B06.1.454.CMB.1.raw
  modified_base (420)..(445): a, c, t, g, unknown or other
  misc_feature (420)..(445): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattgggccagggagccctggtcaccgtcctcctcacgccctccaccgaacgggcccacgtccggttcccttcccccgtggcccgtcccgtcgccctccgaggacgccaccccgtaccgagacgaccaccaggccggcccgtcgggctcgccgtggtacgacggtacctaccttccccaattaccgtccgttacctggacggtccggggtctggaccgaaggtccggataagtacggnnnnnnnnnnnnnnnnnnnnnnnnnn

SEQ ID NO: 200646 - DNA, 571 bp, Homo sapiens
  misc_feature: GYAE6OF02FWEBN.18.17.B06.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
  modified_base (395)..(396): a, c, t, g, unknown or other
  misc_feature (395)..(396): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggcacgatttggggccgcatgaacttccactttgacttattggggccaggganccctggtcaccggtctcctcacgcctccaccaagggcccagtcggtccttccccgngccgccctgcctccgaggtacgccacctcgagngaccacgcgcggccctgggcctggccctggtcaacggtactaccttcccgaattacgtccggtactgagcgggctcggacaaggcacgagtagcagtcagtcagctcnncgactcgaatgaactgactgacttagnacngagtgtacgagactacgtagtcagacgtcgtacgtggtacttacgcttaacgcgacgtacgtacgcggttacgacgttacgttctacggccgttacgttacgacgttaccgttaccgacggtacgtttaccgaccggttctaacg

SEQ ID NO: 200647 - DNA, 196 bp, Homo sapiens
  misc_feature: GYAE6OF02IXXQB.18.17.B06.1.454.CMB.1.raw
  modified_base (141)..(141): a, c, t, g, unknown or other
  misc_feature (141)..(141): n is a, c, g, or t
  modified_base (167)..(196): a, c, t, g, unknown or other
  misc_feature (167)..(196): n is a, c, g, or t
tcagtacgagtatgcacgaccggtgctcgatttagtcgatagtgaagggccgattcaccatctccagagacaatttccaagaacacggtgtcaatggaaatgaacagcctgagagtctgagagacggctagtctatttcgngtgacggaaaggaccacgttaggttnnnnnnnnnnnnnnnnnnnnnnnnnnnnnn

SEQ ID NO: 200648 - DNA, 434 bp, Homo sapiens
  misc_feature: GYAE6OF02GTRFM.18.17.B06.1.454.CMB.1.raw
  modified_base (196)..(196): a, c, t, g, unknown or other
  misc_feature (196)..(196): n is a, c, g, or t
  modified_base (288)..(288): a, c, t, g, unknown or other
  misc_feature (288)..(288): n is a, c, g, or t
  modified_base (395)..(395): a, c, t, g, unknown or other
  misc_feature (395)..(395): n is a, c, g, or t
  modified_base (397)..(434): a, c, t, g, unknown or other
  misc_feature (397)..(434): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactatgggccaggganccctggtcaccgtctcctcagcctccaccgaacgggcccatccggtccttccccctggccgccctgcctcccacggagccacccgtccgagngcacagccggccccgtggggcctggccctggtaccgaaggaccttaccttccccaagtccttaccgtactggacggccgggcgtcggacgaacggctaccgatagcngnnnnnnnnnnnnnnnnnnnnnnnnnnnnnnnnnnnnnn

SEQ ID NO: 200649 - DNA, 484 bp, Homo sapiens
  misc_feature: GYAE6OF02JBEZ0.18.17.B06.1.454.CMB.1.raw
  modified_base (200)..(200): a, c, t, g, unknown or other
  misc_feature (200)..(200): n is a, c, g, or t
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
  modified_base (322)..(322): a, c, t, g, unknown or other
  misc_feature (322)..(322): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (387)..(388): a, c, t, g, unknown or other
  misc_feature (387)..(388): n is a, c, g, or t
  modified_base (390)..(392): a, c, t, g, unknown or other
  misc_feature (390)..(392): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (448)..(449): a, c, t, g, unknown or other
  misc_feature (448)..(449): n is a, c, g, or t
  modified_base (451)..(451): a, c, t, g, unknown or other
  misc_feature (451)..(451): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
tcagtacgagtatgcacgaccggtgctcgatttagtcgatagtgaagggtccgattcaccatctccagagacaattccaagaacacggtgtcaatggaaatgaacagcctgagagctgaggacacggctgtctatttctgtgcgaaggacacgatttggggccgcatgaacttccacttttgactattggggccaggganccctggtcaccgtctcctcagcctccaccaaggcccatcgtcttccccngcgcctgcctccaggacgcacctccgagagcacagccggcctggctgccnggtcaaggctaccttccactacncgtactgacgcgggctggactacggcgacagtacgacnagtcacgtcgagatcgancgacgngcnngnnngacncgactcgtangacgacgagagngngcgcgagtagtcgcgacgcgcgcncncnncncncncncncncacacnacncncncgcncncncg

SEQ ID NO: 200650 - DNA, 368 bp, Homo sapiens
  misc_feature: GYAE6OF02FSST7.18.17.B06.1.454.CMB.1.raw
  modified_base (198)..(198): a, c, t, g, unknown or other
  misc_feature (198)..(198): n is a, c, g, or t
  modified_base (356)..(356): a, c, t, g, unknown or other
  misc_feature (356)..(356): n is a, c, g, or t
  modified_base (360)..(368): a, c, t, g, unknown or other
  misc_feature (360)..(368): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccaggganccctggtcaccgtctcctcagcctccaccaacgggcccatcggtccttccccctggccgccctgcctccgaggacgcaccctccgagacgcacagcggccctgggctgcctggtcaaggcctaccttccatacctcgtactgacgcggctggcaggcncatnnnnnnnnn

SEQ ID NO: 200651 - DNA, 369 bp, Homo sapiens
  misc_feature: GYAE6OF02G2U5C.18.17.B06.1.454.CMB.1.raw
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (353)..(354): a, c, t, g, unknown or other
  misc_feature (353)..(354): n is a, c, g, or t
  modified_base (356)..(369): a, c, t, g, unknown or other
  misc_feature (356)..(369): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccacttttgactatttggggccagggagccctggtcaccgtctcctcagcctccaccagggcccagtcggtcttcccctggcnccctgctccaggancacctccgagagccacagccggccctggctgcctggtcaaggctactccatactcgtactgacgcggctggcaaggcgcatagnngnnnnnnnnnnnnnn

SEQ ID NO: 200652 - DNA, 439 bp, Homo sapiens
  misc_feature: GYAE6OF02IL0IR.18.17.B06.1.454.CMB.1.raw
  modified_base (406)..(406): a, c, t, g, unknown or other
  misc_feature (406)..(406): n is a, c, g, or t
  modified_base (408)..(410): a, c, t, g, unknown or other
  misc_feature (408)..(410): n is a, c, g, or t
  modified_base (412)..(439): a, c, t, g, unknown or other
  misc_feature (412)..(439): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactatggggccagggagccctggtcaccgtctcctcacgcctccaccaagggccccagtccggtccttcccccgtgggccgcccctgccttccgaggacgccacctccgaagcgccacgacggccgccccgtggggcctcggccgttgggtacaacgggaccttacctacccattacctcgttactggtacggccggggtctaggcaaacgggcactacgtaggcncnnngnnnnnnnnnnnnnnnnnnnnnnnnnnnn

SEQ ID NO: 200653 - DNA, 466 bp, Homo sapiens
  misc_feature: GYAE6OF02GZPHE.18.17.B06.1.454.CMB.1.raw
  modified_base (201)..(201): a, c, t, g, unknown or other
  misc_feature (201)..(201): n is a, c, g, or t
  modified_base (408)..(410): a, c, t, g, unknown or other
  misc_feature (408)..(410): n is a, c, g, or t
  modified_base (412)..(412): a, c, t, g, unknown or other
  misc_feature (412)..(412): n is a, c, g, or t
  modified_base (416)..(417): a, c, t, g, unknown or other
  misc_feature (416)..(417): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (424)..(466): a, c, t, g, unknown or other
  misc_feature (424)..(466): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagtttgggggccgcatgaacttccatttgactagttggggccagggganccctggtcaccgtctcctcacgcctccaccgaacgggcccatccggtccttcccccgtggccgcccctgcctccaggacgcaccctccgagacgccacgacggccggccctcggggcctcggccgtggtaccgaacgggtaccttacccttccctactacctcgttaacgtggacggcggggcgtggccgaacggcgacgactacgnnngnatgnngancncnnnnnnnnnnnnnnnnnnnnnnnnnnnnnnnnnnnnnnnnnnn

SEQ ID NO: 200654 - DNA, 375 bp, Homo sapiens
  misc_feature: GYAE6OF02GG2XA.18.17.B06.1.454.CMB.1.raw
  modified_base (271)..(271): a, c, t, g, unknown or other
  misc_feature (271)..(271): n is a, c, g, or t
  modified_base (364)..(375): a, c, t, g, unknown or other
  misc_feature (364)..(375): n is a, c, g, or t
tcagtacgagtatgcacgaccggtgctcgatttagtcgatagtgaagggccgattcaccatctccagagacaattccaagaacacggtgtcaatggaaatgaaaagcctgagagctgaggacacggctgtctatttctgtgcgaaggacacgatttggggccgcatgaacttccactttgactattggggccagggagccctggtcaccgtctcctcacgcctccaccaagggcccatcggtcttccccctggccgccctgcctccagganccacctccgagagcacagcggccctgggctgccctggtcaaggacctacgttcccattacctcgtactgacggcggctggcaaggcgcatagnnnnnnnnnnnn

SEQ ID NO: 200655 - DNA, 410 bp, Homo sapiens
  misc_feature: GYAE6OF02HM802.18.17.B06.1.454.CMB.1.raw
  modified_base (268)..(268): a, c, t, g, unknown or other
  misc_feature (268)..(268): n is a, c, g, or t
  modified_base (278)..(278): a, c, t, g, unknown or other
  misc_feature (278)..(278): n is a, c, g, or t
  modified_base (385)..(410): a, c, t, g, unknown or other
  misc_feature (385)..(410): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattgggccagggagccctggtcaccgtctcctcagcctccaccaagggcccatccggtcttccccctggcgccctgctccgaggnccacctcganagcacgagtccggccctggggctcgccgtaggtcaacgggacctaccgttccccagtacctcgtacctggacgccggggctgggaccaaaggccggacaataggcgnnnnnnnnnnnnnnnnnnnnnnnnnn

SEQ ID NO: 200656 - DNA, 370 bp, Homo sapiens
  misc_feature: GYAE6OF02IRZZJ.18.17.B06.1.454.CMB.1.raw
  modified_base (273)..(273): a, c, t, g, unknown or other
  misc_feature (273)..(273): n is a, c, g, or t
  modified_base (353)..(353): a, c, t, g, unknown or other
  misc_feature (353)..(353): n is a, c, g, or t
  modified_base (359)..(370): a, c, t, g, unknown or other
  misc_feature (359)..(370): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccatccggtccttccccctggccgccctgcctccaggacnccacctccgagagcacagccggccctgggctgcctggcaaggactactcccatactcgtactgagcggctggacgaggcncatagnnnnnnnnnnnn

SEQ ID NO: 200657 - DNA, 500 bp, Homo sapiens
  misc_feature: GYAE6OF02I9RE2.18.17.B06.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (450)..(500): a, c, t, g, unknown or other
  misc_feature (450)..(500): n is a, c, g, or t
tcagtacgagtatgcacgaccggtgctcgatttagtcgatagtgaagggccgagttcaccatctccagagacaattccaagaacacggtggtcaatggaaatgaacagcctgagagctggaggacacgggctgtctatttctgtgcgaaggacacgatttggggccgcatgaacttccactttgactagttcggggccagggancccgtggtcacccgtcctcctcagcctccaccgaagggccccatcggtccttcccccnggccgccctgcctcccaggagcacccgtccgagacggcaaccaggtcggccccctagggggtccttcggcccgttgggaccgtaaagggccctttaaccgttccccaagttcctaccgtacctttgggacgtaccgggggtcttggggacctaaggggacccgtctaaacgtcggngctaancggngnnnnnnnnnnnnnnnnnnnnnnnnnnnnnnnnnnnnnnnnnnnnnnnnnnn

SEQ ID NO: 200658 - DNA, 517 bp, Homo sapiens
  misc_feature: GYAE6OF02IW5E3.18.17.B06.1.454.CMB.1.raw
  modified_base (201)..(201): a, c, t, g, unknown or other
  misc_feature (201)..(201): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
  modified_base (456)..(457): a, c, t, g, unknown or other
  misc_feature (456)..(457): n is a, c, g, or t
  modified_base (460)..(460): a, c, t, g, unknown or other
  misc_feature (460)..(460): n is a, c, g, or t
  modified_base (462)..(464): a, c, t, g, unknown or other
  misc_feature (462)..(464): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (479)..(479): a, c, t, g, unknown or other
  misc_feature (479)..(479): n is a, c, g, or t
  modified_base (483)..(484): a, c, t, g, unknown or other
  misc_feature (483)..(484): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (491)..(492): a, c, t, g, unknown or other
  misc_feature (491)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (506)..(507): a, c, t, g, unknown or other
  misc_feature (506)..(507): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgacttagttggggccagggacncccgtgtccaccgtctcctcagcctccaccaagggcccagtcggtccttcccccgtggccgtccctgccttccgaggtacgctaccgtccgagacgccacgagccggccctcggggcctggcccgtggtaccaacgggtacctacttcccacgtacctcgtacctggagccgggtactcgggccgaaggtcgacgtaactacggctanacgctngtcntacgcagccatgcgncgtantgatcncgtnacgtnanngtntnnntcngngtcgngcgtntacnncncgncnngncncngngngacnnatncgtntac

SEQ ID NO: 200659 - DNA, 373 bp, Homo sapiens
  misc_feature: GYAE6OF02GB1D4.18.17.B06.1.454.CMB.1.raw
  modified_base (258)..(258): a, c, t, g, unknown or other
  misc_feature (258)..(258): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (358)..(373): a, c, t, g, unknown or other
  misc_feature (358)..(373): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaacgggcccatccggtccttccccctggccnccctgctccaggacgcacctccgagagcacagccggcccctggctcgcctggcaaggctactccatactcgtactgacgngggctggcaaggcncatagnnnnnnnnnnnnnnnn

SEQ ID NO: 200660 - DNA, 698 bp, Homo sapiens
  misc_feature: GYAE6OF02IG64Z.18.17.B06.1.454.CMB.1.raw
  modified_base (166)..(166): a, c, t, g, unknown or other
  misc_feature (166)..(166): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
  modified_base (535)..(535): a, c, t, g, unknown or other
  misc_feature (535)..(535): n is a, c, g, or t
tcagtacgagtatgcacgaccggtgctcgattttagtcgatagtgaagggccgattcaccatctccagagacaattccaagaacacggtgtcaatggaaatgaacagcctgagagctgaggacacggctgtctatttctgtcgcgaaggacacgagtttggggccncatgaacttccactttgactacgtgggccagggcacgtccggtcaccgtctcctcgacgcctccaaccgaacgggcccctacgttccggttcccttcccccgtcggccctacccccttccgtaccgtaaacgaccgcctaacccgttcggtcgggggaccaccgacggcccggaccccgttcggggtccgttccggcccgttacgggtacccgaaacgggtacccgttaaccgttccccgtaacgttaccgttccggtaacgtcggaacggtccgggtaccgtcgggacgaacgggccgacgaacgttacggcagtacgntacgngacgcgtcgngacgacncgtcacgctagcacggtacacacgacncgacactacgtacgtacgtcgtacgacgacgacgtactacgtacgagacgtacggtacgtacgtacgtacgtacgtacgtacggacggtacggtacggtacggtacgtacgtaacgtacgtacgttacgtacggtaccggtacggtacggtaccgtacgtacg

SEQ ID NO: 200661 - DNA, 479 bp, Homo sapiens
  misc_feature: GYAE6OF02IRQY2.18.17.B06.1.454.CMB.1.raw
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (429)..(431): a, c, t, g, unknown or other
  misc_feature (429)..(431): n is a, c, g, or t
  modified_base (433)..(479): a, c, t, g, unknown or other
  misc_feature (433)..(479): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttgggggccgcatgaaccttccactttgactattggggccagggagccctggtcaccgtctcctcacgcctccaccaacgggcccagtcggtccttcccccgtggccgccctcgcctccaggtagccacctccggagagcacgaggccggcccgtgggcctcggccgttcggtacgaaacgggtaccttaaccttaccccgactaccttccgtacgtacggacgggccggggtcgtgggaccgtaacggcgactaacgtagcntngactgatagnnncnnnnnnnnnnnnnnnnnnnnnnnnnnnnnnnnnnnnnnnnnnnnnnn

SEQ ID NO: 200662 - DNA, 426 bp, Homo sapiens
  misc_feature: GYAE6OF02F4COV.18.17.B06.1.454.CMB.1.raw
  modified_base (198)..(198): a, c, t, g, unknown or other
  misc_feature (198)..(198): n is a, c, g, or t
  modified_base (394)..(395): a, c, t, g, unknown or other
  misc_feature (394)..(395): n is a, c, g, or t
  modified_base (397)..(398): a, c, t, g, unknown or other
  misc_feature (397)..(398): n is a, c, g, or t
  modified_base (400)..(426): a, c, t, g, unknown or other
  misc_feature (400)..(426): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccaggganccctggtcaccgtctcctcagcctccaccgaacgggcccatcggtccttcccccgtggccgccctgcctcccaggacgcacccgtccgagacgccacacgccggcccctgggccttcggccgtggtacaaagggacctaccgttccccaattacctacgtactggacggcggggctggccaaggcgacgaatagcnngnncnnnnnnnnnnnnnnnnnnnnnnnnnnn

SEQ ID NO: 200663 - DNA, 404 bp, Homo sapiens
  misc_feature: GYAE6OF02HG2RJ.18.17.B06.1.454.CMB.1.raw
  modified_base (350)..(350): a, c, t, g, unknown or other
  misc_feature (350)..(350): n is a, c, g, or t
  modified_base (358)..(363): a, c, t, g, unknown or other
  misc_feature (358)..(363): n is a, c, g, or t
  modified_base (365)..(404): a, c, t, g, unknown or other
  misc_feature (365)..(404): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaagggcccaatcgtctccccctggcgcctgctcagcgcactccgagagcacagcgccctgggctgcctggtcaaggctaacttcccatacctcgtactgagtcggctggcacggtcgcatagnagctagcnnnnnngnnnnnnnnnnnnnnnnnnnnnnnnnnnnnnnnnnnnnnnn

SEQ ID NO: 200664 - DNA, 400 bp, Homo sapiens
  misc_feature: GYAE6OF02J05J4.18.17.B06.1.454.CMB.1.raw
  modified_base (150)..(150): a, c, t, g, unknown or other
  misc_feature (150)..(150): n is a, c, g, or t
  modified_base (216)..(216): a, c, t, g, unknown or other
  misc_feature (216)..(216): n is a, c, g, or t
  modified_base (349)..(349): a, c, t, g, unknown or other
  misc_feature (349)..(349): n is a, c, g, or t
  modified_base (372)..(400): a, c, t, g, unknown or other
  misc_feature (372)..(400): n is a, c, g, or t
tcagtacgagtatgcacgaccggtgctcgatttagtcgatagtgaagggccggattcaccatctccagagacaattccaagaacacggtgtcaatggaaatgaacagcctgagagctgaggacacggctgtctatttctgtgcgaagganacgattcgggcgcatgaacttccactttgactattggggccagggacgccctggtcaccgtctccnccagcctccaccaaggccatcggtccttccccctggcgccctgcctccgaggacgcacctcgagacgcacacgcgccctggctgccgtggtcaagacctacgtcccgtataccctcggtctacgacggtcggngtacggcacggtcgacacgtagnnnnnnnnnnnnnnnnnnnnnnnnnnnnn

SEQ ID NO: 200665 - DNA, 495 bp, Homo sapiens
  misc_feature: GYAE6OF02JHS0C.18.17.B06.1.454.CMB.1.raw
  modified_base (438)..(439): a, c, t, g, unknown or other
  misc_feature (438)..(439): n is a, c, g, or t
  modified_base (443)..(443): a, c, t, g, unknown or other
  misc_feature (443)..(443): n is a, c, g, or t
  modified_base (446)..(495): a, c, t, g, unknown or other
  misc_feature (446)..(495): n is a, c, g, or t
tcagtacgagtatgcacgaccggtgctcgatttagtcgatagtgaagggccgattcaccatctccagagacaattccaaagaacacggtgtcaatggaaatgaacagcctgagagctgaggacacgctgtctatttctgtgcgaaggacacgtatttggggccgcatgaacttccatttgactagttggggccagggacgccctggtccaccgtctcctcacgcctccaacaacggcccatccggtccttcccccgtggccgcctcgacctccgaaggacgcccaacccgtccgaagacgacctacgacgcccgggaccccgtggggtcctacgtccccgttagggaccgtaaacgggaccttaacccttaccccgaattacccgtcgtacctgggaacggccggggtatcgggaccgaaggtccgactaagtagctnnacgncgnnnnnnnnnnnnnnnnnnnnnnnnnnnnnnnnnnnnnnnnnnnnnnnnnn

SEQ ID NO: 200666 - DNA, 559 bp, Homo sapiens
  misc_feature: GYAE6OF02JD26N.18.17.B06.1.454.CMB.1.raw
  modified_base (456)..(456): a, c, t, g, unknown or other
  misc_feature (456)..(456): n is a, c, g, or t
  modified_base (462)..(463): a, c, t, g, unknown or other
  misc_feature (462)..(463): n is a, c, g, or t
  modified_base (468)..(468): a, c, t, g, unknown or other
  misc_feature (468)..(468): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (495)..(496): a, c, t, g, unknown or other
  misc_feature (495)..(496): n is a, c, g, or t
  modified_base (501)..(502): a, c, t, g, unknown or other
  misc_feature (501)..(502): n is a, c, g, or t
  modified_base (509)..(509): a, c, t, g, unknown or other
  misc_feature (509)..(509): n is a, c, g, or t
  modified_base (513)..(513): a, c, t, g, unknown or other
  misc_feature (513)..(513): n is a, c, g, or t
  modified_base (515)..(516): a, c, t, g, unknown or other
  misc_feature (515)..(516): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(530): a, c, t, g, unknown or other
  misc_feature (528)..(530): n is a, c, g, or t
  modified_base (533)..(533): a, c, t, g, unknown or other
  misc_feature (533)..(533): n is a, c, g, or t
  modified_base (538)..(538): a, c, t, g, unknown or other
  misc_feature (538)..(538): n is a, c, g, or t
  modified_base (541)..(546): a, c, t, g, unknown or other
  misc_feature (541)..(546): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (557)..(558): a, c, t, g, unknown or other
  misc_feature (557)..(558): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgaagtttggggccgcatgaacttccactttgactattggggccagggagccctggtcaccggtctcctcagccctccacccgtaacggcccactcggtccttccccccgtggccgtccctagcctccaggacgccaccgtccggaacgtagccacacggtcccggcccctggggccttcggcccgtgggtaccaaacgggtaaccttacccgttacccctaagtaacccgttccgtaccgttaacggcgggtacccgggtcggttacgggaccgtaaacgggtccgtaacccaagttaacgggancgtacnngactntncgcgcncnctanacgncgcgngtcnncgacnngcgtacntctnannancncntnangnnntancgagntgnnnnnnancgnagncgnnc

SEQ ID NO: 200667 - DNA, 436 bp, Homo sapiens
  misc_feature: GYAE6OF02IURC0.18.17.B06.1.454.CMB.1.raw
  modified_base (199)..(199): a, c, t, g, unknown or other
  misc_feature (199)..(199): n is a, c, g, or t
  modified_base (251)..(251): a, c, t, g, unknown or other
  misc_feature (251)..(251): n is a, c, g, or t
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (394)..(436): a, c, t, g, unknown or other
  misc_feature (394)..(436): n is a, c, g, or t
tcagtacgagtatgcacgaccggtgctcgatttagtcgatagtgaagggcccgattcaccatctccagagacaattccaagaacacggtgtcaatggaaatgaacagcctgagagctgaggacacggctgtctatttctgtgcgaaggacacgatttggggccgcatgaacttccactttgactattggggccaggganccctggtcaccgtctcctcagcctcacccaaggcccatcggtcttcccccgngccgccctncctccaggactccaccctaccgganacgtcaacaggccggccccgtggggcctcgccttggtcaaaggccctaccttacccattacctcgttacgtgaacggccgggcgtcgtacgaaggtccgacatacggannnnnnnnnnnnnnnnnnnnnnnnnnnnnnnnnnnnnnnnnnn

SEQ ID NO: 200668 - DNA, 660 bp, Homo sapiens
  misc_feature: GYAE6OF02G31VU.18.17.B06.1.454.CMB.1.raw
  modified_base (238)..(238): a, c, t, g, unknown or other
  misc_feature (238)..(238): n is a, c, g, or t
  modified_base (352)..(352): a, c, t, g, unknown or other
  misc_feature (352)..(352): n is a, c, g, or t
  modified_base (455)..(455): a, c, t, g, unknown or other
  misc_feature (455)..(455): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (528)..(530): a, c, t, g, unknown or other
  misc_feature (528)..(530): n is a, c, g, or t
  modified_base (535)..(535): a, c, t, g, unknown or other
  misc_feature (535)..(535): n is a, c, g, or t
  modified_base (538)..(538): a, c, t, g, unknown or other
  misc_feature (538)..(538): n is a, c, g, or t
  modified_base (558)..(558): a, c, t, g, unknown or other
  misc_feature (558)..(558): n is a, c, g, or t
tcagtacgagtatgcacgaccggtgctcgatttagtcgatagtgaagggccgattcaccatctccagagacaattccaagaacacggtctatctacgaaatgaaccagtcctgagagccgaggacacggtccctagtatttctagtgtagagagatacgtaaaacgtttccctttacgattgtttaccttggaattatggtgggggccaaaggggacaagtggtaccaccgtctcctnacgccctccaccaacgggcccagttccggtacctttcccccggaggccggtaccctgaccgtccaggacgaccctaccttaccccggaggaacgcaccgaaggccgtaccccgnggggcctaggcccgtttcgcggaacggacctaccgttaccctaactacgtttacggttactaccggtaagggcccggggacttacggggaccgaacggggacnccggaaaatttccaggccgaagtttccaatagggccaanacgnganacgagcanatnagatagatnagngtannnatatntancgtacgactacgcgatacgntacggtcgttactaagtacaataagtagtaccgtacagtaggtaccggttaacgttacgtaagacgtacgtacgaccgtacgaacgtacgtagtaccctacg

SEQ ID NO: 200669 - DNA, 620 bp, Homo sapiens
  misc_feature: GYAE6OF02HPHOG.18.17.B06.1.454.CMB.1.raw
  modified_base (138)..(138): a, c, t, g, unknown or other
  misc_feature (138)..(138): n is a, c, g, or t
  modified_base (198)..(198): a, c, t, g, unknown or other
  misc_feature (198)..(198): n is a, c, g, or t
  modified_base (437)..(437): a, c, t, g, unknown or other
  misc_feature (437)..(437): n is a, c, g, or t
  modified_base (480)..(480): a, c, t, g, unknown or other
  misc_feature (480)..(480): n is a, c, g, or t
  modified_base (513)..(513): a, c, t, g, unknown or other
  misc_feature (513)..(513): n is a, c, g, or t
  modified_base (533)..(533): a, c, t, g, unknown or other
  misc_feature (533)..(533): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttcngtgcgaagacacgatttgggccgcgatgaacttccactttgactagttgggccagggacncccgtggtccaccgtctccgtcgacgcctccaccgtacggcccagtccggtccttccccgtggccgacctcgcctaccgaggacgaccgtaccgtacgagacgacgacgacggccggtccggtaggcctacgtaccgttacggtaaccgaacggtaccttaaccgttacccgtaacgttaccgttaccgtacgtacggtaccggccggtacgtacggacgaacggcgtacgacgtacgncgtagcgacgacgcgactacgctacgacgcgacgcgtagacgngtcgatacacgagtacgacgtgtacgacgtacncgacgtacgcacgacgacgngtacagtacgcgtagacgacgttagcgtacgtacgtacgtacgtacgacgtacgacgtacgtacgtacgacgacgtacgtacgtacg

SEQ ID NO: 200670 - DNA, 496 bp, Homo sapiens
  misc_feature: GYAE6OF02GDUGT.18.17.B06.1.454.CMB.1.raw
  modified_base (294)..(294): a, c, t, g, unknown or other
  misc_feature (294)..(294): n is a, c, g, or t
  modified_base (425)..(425): a, c, t, g, unknown or other
  misc_feature (425)..(425): n is a, c, g, or t
  modified_base (451)..(451): a, c, t, g, unknown or other
  misc_feature (451)..(451): n is a, c, g, or t
  modified_base (454)..(496): a, c, t, g, unknown or other
  misc_feature (454)..(496): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgagttttggggccgcatgtaacttcctacttttgacttagttggggccagggacgccctggtcaccgtctcctcagcctccaccgaacggccctacgtccggtccttcccccgtcggccgtccctgccttccgaaggggaccnccacccgtaccggagtacgccgtaaccgacggccgggcccccgttagggcctacggcccggttacgggtacgaaacgggtccttaacccgttccctaacgttacctcgtaaccttgggacggtaccggggntacgggacaacgggccagtatacggnacnnnnnnnnnnnnnnnnnnnnnnnnnnnnnnnnnnnnnnnnnnn

SEQ ID NO: 200671 - DNA, 367 bp, Homo sapiens
  misc_feature: GYAE6OF02GI2ZU.18.17.B06.1.454.CMB.1.raw
  modified_base (352)..(352): a, c, t, g, unknown or other
  misc_feature (352)..(352): n is a, c, g, or t
  modified_base (359)..(367): a, c, t, g, unknown or other
  misc_feature (359)..(367): n is a, c, g, or t
tcagtacgagtatgcacgaccggtgctcgatttagtcgatagtgaagggccgattcaccatctccagagacaattccaagaacacggtgtcaatggaaatgaacagcctgagagctgaggacacggctgtctatttctgtgcgaaggacacgatttggggccgcatgaacttccactttgactattggggccagggagccctggtcaccgtctcctcagcctccaccaaggcccatcggtccttccccctggccgccctgctccaggcgcacctccggagacgcacagcggccctgggctgcctggtcaaggctactcccatactcgtactgagcggggctgggcaaggcgnagtacgnnnnnnnnn

SEQ ID NO: 200672 - DNA, 246 bp, Homo sapiens
  misc_feature: GYAE6OF01BQQ0K.21.46.E02.1.454.CMB.1.raw
  modified_base (243)..(246): a, c, t, g, unknown or other
  misc_feature (243)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnn

SEQ ID NO: 200673 - DNA, 496 bp, Homo sapiens
  misc_feature: GYAE6OF01DF7JF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggcagcagtcacgttgactatcagtgaagtccaggcagaggacgaggctgactattactgtacaaacagtagacagtagaggtactcattgggtgttcggcggagggaccgaagctagaccgtctaggtcacgaccaggctgcccctcgg

SEQ ID NO: 200674 - DNA, 246 bp, Homo sapiens; identical to SEQ ID NO: 200672
  misc_feature: GYAE6OF01DQHR2.21.46.E02.1.454.CMB.1.raw
  modified_base (243)..(246): a, c, t, g, unknown or other
  misc_feature (243)..(246): n is a, c, g, or t

SEQ ID NO: 200675 - DNA, 511 bp, Homo sapiens
  misc_feature: GYAE6OF01BHN8B.21.46.E02.1.454.CMB.1.raw
  modified_base (237)..(237): a, c, t, g, unknown or other
  misc_feature (237)..(237): n is a, c, g, or t
  modified_base (254)..(254): a, c, t, g, unknown or other
  misc_feature (254)..(254): n is a, c, g, or t
  modified_base (309)..(309): a, c, t, g, unknown or other
  misc_feature (309)..(309): n is a, c, g, or t
  modified_base (408)..(408): a, c, t, g, unknown or other
  misc_feature (408)..(408): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaatntgcttattggtaccaanagaagccaggccaggcccctgtgttagtgatatataaagacactgagaggccctnagagatccctgagcgattctctggctcagctcagggacagcagtcacgttgactatcagtgaagtcaggcagagacgaggctgactatactgtacaacngtagacagtagaggtactcgagttgggtgttcggacggtacgggaccagcgtacggacccgtcgtaggtccgacgaccccgaaggcctcggcccccgttacgg

SEQ ID NO: 200676 - DNA, 246 bp, Homo sapiens; identical to SEQ ID NO: 200672
  misc_feature: GYAE6OF01DQDYV.21.46.E02.1.454.CMB.1.raw
  modified_base (243)..(246): a, c, t, g, unknown or other
  misc_feature (243)..(246): n is a, c, g, or t

SEQ ID NO: 200677 - DNA, 492 bp, Homo sapiens
  misc_feature: GYAE6OF01EZT5M.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttatggtaccaacagaagccaggccaggcccctgtgttagtgatatataaagacactgagaggccctcagagatccctgagcgattctctggctcagctcgagggacagcagtcacgttgactatcagtgaagtccaggcagaggacgaggctgactattactgtacaaacagtagacagtagagtactcagttggtgttcggcggagggacgaagctgccgtctaggtcagcccaaggcctgccccgtcg

SEQ ID NO: 200678 - DNA, 249 bp, Homo sapiens
  misc_feature: GYAE6OF01A86IU.21.46.E02.1.454.CMB.1.raw
  modified_base (243)..(249): a, c, t, g, unknown or other
  misc_feature (243)..(249): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcccgagcgacgactgagcgggctggcaaggcgcatagnnnnnnn

SEQ ID NO: 200679 - DNA, 504 bp, Homo sapiens
  misc_feature: GYAE6OF01DKYMP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatcccctgagcgattctctggctccagctcagggcagcagtcacgttgactatcagtgaagtccaggcagaggacgaggctgactattactgtacaaacagtagacagtagaggtactcattgggtgttcggcggagggaccgaagctggaccgtccgtaggtccagacccaaggctgcccccgtcgg

SEQ ID NO: 200680 - DNA, 500 bp, Homo sapiens
  misc_feature: GYAE6OF01EID2F.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtcccaggacagacggccaggatcacctgctctgcagatggactgccaaagaaatatgcttattggtaccaacagaagccaaggccaggcccctgtgttagtgatatataaaagacactgagaggccctnagagatccctgagcgattctctggctccagctcagggacagcagtcacgttgactatcagtgaagtccaggcagaggacgaggctgactattactgtacaaacgagtagacagtagaggtactcagttgggtgttcggcggagggaccaaggctggaccgtcctaggcagcccaaggctgcccctcgg

SEQ ID NO: 200681 - DNA, 247 bp, Homo sapiens
  misc_feature: GYAE6OF01AOD3D.21.46.E02.1.454.CMB.1.raw
  modified_base (243)..(247): a, c, t, g, unknown or other
  misc_feature (243)..(247): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnn

SEQ ID NO: 200682 - DNA, 501 bp, Homo sapiens
  misc_feature: GYAE6OF01EB4SY.21.46.E02.1.454.CMB.1.raw
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatcccctgagcgattctctggctccagctcagggacagcagtcacgttgactatcagtgaagtccaggcagaggacgaggctgactattactgtcaaacngtagacagtagaggtactnagttgggtgttcgggcggagggaccaggctggaccgtcgtaggtcagcccaaggctcgccccgtcgg

SEQ ID NO: 200683 - DNA, 244 bp, Homo sapiens
  misc_feature: GYAE6OF01EZT8K.21.46.E02.1.454.CMB.1.raw
  modified_base (242)..(244): a, c, t, g, unknown or other
  misc_feature (242)..(244): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcctcgtctctactgagcgggctggcaaggcgcatagnnn

SEQ ID NO: 200684 - DNA, 507 bp, Homo sapiens
  misc_feature: GYAE6OF01DKU5Q.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatcccctgagcgattctctggctccagctcagggcagcagtcacgttgactatcagtgaagtccaggcaagaggacgaggctaggactattactgtacaaacagtagaacagtagaggtactctagttgggtgttcggcggtagggaccgaagcgtgaccgtcctaggtcagacccaggcctgccccgtcgg

SEQ ID NO: 200685 - DNA, 419 bp, Homo sapiens
  misc_feature: GYAE6OF01B47BB.21.46.E02.1.454.CMB.1.raw
  modified_base (312)..(312): a, c, t, g, unknown or other
  misc_feature (312)..(312): n is a, c, g, or t
  modified_base (406)..(406): a, c, t, g, unknown or other
  misc_feature (406)..(406): n is a, c, g, or t
  modified_base (411)..(419): a, c, t, g, unknown or other
  misc_feature (411)..(419): n is a, c, g, or t
tcagtcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattcctggggccagggaccctggtaaccgtctcctcagcctccaccaagggcccatcggtcttccccctggcnccctgctccaggagcacctccgagagcacagcggccctgggctgcctggtcaaggctacttcccgagcgacgactgagcgggctggcaaggcgnatagnnnnnnnnn

SEQ ID NO: 200686 - DNA, 245 bp, Homo sapiens
  misc_feature: GYAE6OF01EL9LU.21.46.E02.1.454.CMB.1.raw
  modified_base (243)..(245): a, c, t, g, unknown or other
  misc_feature (243)..(245): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnn

SEQ ID NO: 200687 - DNA, 271 bp, Homo sapiens
  misc_feature: GYAE6OF01B54E5.21.46.E02.1.454.CMB.1.raw
  modified_base (246)..(271): a, c, t, g, unknown or other
  misc_feature (246)..(271): n is a, c, g, or t
tcagtcgtcgctcgcacgaccggtgctcgatttagactcatctacagggaaagggactggtagtggttattattcctggggccagggaaccctggtaaccgtctcctcagcctccaccaagggcccatcggtcttccccctggcgccctgctccaggagcacctccgagagcaacagcggccctgggctgcctggtcaaggactacttccctcgtctctactgagcgggctggcaaggcgcatagnnnnnnnnnnnnnnnnnnnnnnnnnn

SEQ ID NO: 200688 - DNA, 502 bp, Homo sapiens
  misc_feature: GYAE6OF01A2JH0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagagtactcagttgggtgttcggcggagggaccaaggctggaccgtccgtaggtcacgcccaaggctcggcccctcgg

SEQ ID NO: 200689 - DNA, 517 bp, Homo sapiens
  misc_feature: GYAE6OF01DNC63.21.46.E02.1.454.CMB.1.raw
  modified_base (372)..(372): a, c, t, g, unknown or other
  misc_feature (372)..(372): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtcgttagtgatatataaagacactgagaggccctcagagactccctgagcgattctctggctccagctcagggacagcagtcacgtttgactancagtgaagtccaggcagaggacgaggctagacttaattactgtacaaacagtagacagtagaggtactcagttgggtgttcggacggagggaccaaggtcacggaccgtccgtaggtcacgacccaaggcctcgcccccgttcgg

SEQ ID NO: 200690 - DNA, 493 bp, Homo sapiens
  misc_feature: GYAE6OF01AK5CX.21.46.E02.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctcagctcagggacagcagtcacgttgactatcagtgaagtccaggcagaggacgaggctgactattactgtcaaacngtaagacagtagagtactcattgggtgttcggcggagggaccaagctggaccgtctaggtcagcccaaggctgcccctccgg

SEQ ID NO: 200691 - DNA, 527 bp, Homo sapiens
  misc_feature: GYAE6OF01DOSF1.21.46.E02.1.454.CMB.1.raw
  modified_base (415)..(415): a, c, t, g, unknown or other
  misc_feature (415)..(415): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttatggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactattactagtcaaacgngtaagacagtagaggtactcgattgggtgttacgggcggtaagggaccgaaagcgtaggacccgtccgtaaggttccacggtaccccgaaaggccgtgtccccccgtacggg

SEQ ID NO: 200692 - DNA, 501 bp, Homo sapiens
  misc_feature: GYAE6OF01BG15W.21.46.E02.1.454.CMB.1.raw
  modified_base (312)..(312): a, c, t, g, unknown or other
  misc_feature (312)..(312): n is a, c, g, or t
  modified_base (417)..(417): a, c, t, g, unknown or other
  misc_feature (417)..(417): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (465)..(465): a, c, t, g, unknown or other
  misc_feature (465)..(465): n is a, c, g, or t
  modified_base (490)..(490): a, c, t, g, unknown or other
  misc_feature (490)..(490): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagacaggccaggcccctgtgttagtgatatataaagacactgagaggccctnagagatccctgagcgattctctggctccagctcgagggacagcagtcacgttgactatcagtgaagtccaggcagaggacgaggctgactattactgtacaaacngtaagacagtagagtactanagttgggtgttcggnggaggacgagtcnggaccgtctaggcagacccaaggcncgccccgtcgg

SEQ ID NO: 200693 - DNA, 510 bp, Homo sapiens
  misc_feature: GYAE6OF01CXNUV.21.46.E02.1.454.CMB.1.raw
  modified_base (313)..(313): a, c, t, g, unknown or other
  misc_feature (313)..(313): n is a, c, g, or t
  modified_base (453)..(453): a, c, t, g, unknown or other
  misc_feature (453)..(453): n is a, c, g, or t
tcagtcgtcgctcgcacgaccggtgctcgatttagactcatctacagggaaagggggtgggtccaggaggcagaactctgggtgtctcaccatggcctggatccatctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggccctnagagatccctgagcgattctctggctccagctcgagggacagcagtcacgttgactatcagtgaagtccaggcagaggacgaggctgacttattactgtacaaacagtagacagtagaggtactcagttgggtgtcgggnggagggaccaaggctggacccgtccgtaggtccagacccgaaggcctcggtcccccg

SEQ ID NO: 200694 - DNA, 549 bp, Homo sapiens
  misc_feature: GYAE6OF01CSP7W.21.46.E02.1.454.CMB.1.raw
  modified_base (318)..(318): a, c, t, g, unknown or other
  misc_feature (318)..(318): n is a, c, g, or t
  modified_base (442)..(442): a, c, t, g, unknown or other
  misc_feature (442)..(442): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatatgctttattggtaaccaacagaagccaggccaggcccctgtgttagtgatataataaagacactgagaggcccctanagagactcccgtgagtcgtattctcgtggcctccgagctcgagggacagcagtcacgttgactatcagtgaagtccgaggcaggaggacgaggctagacttattacgtagtacaaacgtgtaanacgagtagacggtactcgtagttgggtgttcgggcggaagggaccgaagccgtacggtacccgtcgtacggtcaccggacccgaaggcccgtccgtcccccgtacgg

SEQ ID NO: 200695 - DNA, 512 bp, Homo sapiens
  misc_feature: GYAE6OF01D0W0T.21.46.E02.1.454.CMB.1.raw
  modified_base (416)..(416): a, c, t, g, unknown or other
  misc_feature (416)..(416): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaaagacactgagaggccctcagagatccctgagcgattctctggctccagctcagggacagcagtcacgttgactatcagtgaagtccaggcagaggacgaggctgactattactgtacaaacngtagacagtagaggtactcagttgggtgttcgggcgggtagggaccgaaaggctggaccgtcgtaggtcgagacccgaaggcctcgcccccgtcgg

SEQ ID NO: 200696 - DNA, 563 bp, Homo sapiens
  misc_feature: GYAE6OF01CGLPM.21.46.E02.1.454.CMB.1.raw
tcagtcgtcgctcgcacgaccggtgctcgatttagactcatctacagggaaaggggtagggtccaggaggcagaactcctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttatggtacaacagaagccaggccaggcccctgtgttagtgatatataaagacactgagaggccctcagagatccctagagcgaattctctggctccgagctcgagggacagtcagtcacgttgactatcagtgaagtcaggcagaggacgaggctagaactattacgtgtaccaaacgagtaagaccaagtagaacggttactacgagttgggtagttccgggacgggtaagggaacctaaggtaccgtaggtaccccggttaccgttagggttaccgaacgtccccggaaagggcctacgggtccccccgttaccggg

SEQ ID NO: 200697 - DNA, 515 bp, Homo sapiens
  misc_feature: GYAE6OF01AM1WK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctcagagatccctgagcgattctctggctccagctcgagggacagcagtcacgttgactatcagtgaagtcaggcagaggacgaggctgactatactgtacaaacagtaagacaggtagagtactagtagttgggtgttcggcggagggaccgaaggcgtaggacccgtaccgtaggacgtacgcccgaaggcctcgcccccgtcgg

SEQ ID NO: 200698 - DNA, 509 bp, Homo sapiens
  misc_feature: GYAE6OF01DKPB5.21.46.E02.1.454.CMB.1.raw
  modified_base (419)..(419): a, c, t, g, unknown or other
  misc_feature (419)..(419): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatataataaagacactgagaggccctcagagatccctgagcgattctctggcctccagctcagggacagcagtcacgttgactatcagtgaagtccaggcaggaggacgaggctgacttattactgtacaanagtagacagtagagtactcagttgggtgttcgggcggaggaccaaggctggaccgtccgtaggtcacgacccaaggctcgcccccgtcgg

SEQ ID NO: 200699 - DNA, 509 bp, Homo sapiens
  misc_feature: GYAE6OF01BQB1K.21.46.E02.1.454.CMB.1.raw
  modified_base (421)..(421): a, c, t, g, unknown or other
  misc_feature (421)..(421): n is a, c, g, or t
  modified_base (447)..(447): a, c, t, g, unknown or other
  misc_feature (447)..(447): n is a, c, g, or t
tcagtcgtcgctcgcacgaccggtgctcgatttagactcatctacagggaaaggggtgggtccaggaggcagaactctgggtgtctcaccatggcctggatccctctaccttctcccctcctcactctctgcacaggctctgaggcctcctatgagctgacacagccaccctcggtgtccagtcgtccccaggacagacggccaggatcacctgctctgcagatggactgccaaagaaatatgcttattggtacctaacagaaagccaggccaggccccctgtcgttagtgatatataaagacactgagaggccctcagagatccctgagcgattctctggctccagctcagggacagcagtcacgttgactatcagtgaagtccgaggcagaggacgaggctgactattactgtacaaangtagacagtagagtactcagttcggngttcggcggagggaccaagtctggaccgtcgtaggtcgagcccgaaggctcggcccctacgg

SEQ ID NO: 200700 - DNA, 494 bp, Homo sapiens
  misc_feature: GYAE6OF01AGXI8.21.46.E02.1.454.CMB.1.raw
  modified_base (310)..(310): a, c, t, g, unknown or other
  misc_feature (310)..(310): n is a, c, g, or t
  modified_base (412)..(412): a, c, t, g, unknown or other
  misc_feature (412)..(412): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctnagagatccctgagcgattctctggctccagctcagggacagcagtcacgttgactatcagtgaagtccaggcagaggacgaggctgactatactgtcaaacngtaagacagtagaggtactcattgggtgttcgggcggagggaccaagctgaccgtctaggtcagcccaaggctgcccctcgg

SEQ ID NO: 200701 - DNA, 503 bp, Homo sapiens
  misc_feature: GYAE6OF01A0FSU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacagtaagacagtagaggtactctagttgggtgttcggcggagggaccaagctgaccgtctaggtcacgcccaaggctcgccccgtcgg

SEQ ID NO: 200702 - DNA, 547 bp, Homo sapiens
  misc_feature: GYAE6OF01BR819.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggccccctgtgttagtgatatataaagacactgagaggccctcagagatcccctgagcgattctctggcctccagctcgagggacagcagtcacgttgactatcagtgaacgtccaggcagaggacgaggctgactattacgtgtacaaacagtaagactagtagaggtactacgtagttgggttgttcgggcgggaacgggaccgaaggtccgtacggtacccgttaccgtacggtacgacgccccgaaaggcccgtcccggccccccgttaccggg

SEQ ID NO: 200703 - DNA, 496 bp, Homo sapiens
  misc_feature: GYAE6OF01EK0VY.21.46.E02.1.454.CMB.1.raw
  modified_base (414)..(414): a, c, t, g, unknown or other
  misc_feature (414)..(414): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctcagagatccctgagcgattctctggctcagctcagggacagcagtcacgttgactatcagtgaagtccaggcagaggacgaggctgactattactgtcaaacngtagacagtagaggtactcgagttgggtgttcggcggaggaccgagctgaccgtcgtaggcagcccaaggctgccccgtcgg

SEQ ID NO: 200704 - DNA, 506 bp, Homo sapiens
  misc_feature: GYAE6OF01AMS4E.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcaggacagcagtcacgttgactatcagtgaagtccaggcagaggacgaggctgactattactgtacaaacagtagacagtagaggttactcagttgggtgttcggcggagggaccgtaagcgtagccgtccgtaggtcaggacccaaggcctgcccccgtacgg

SEQ ID NO: 200705 - DNA, 245 bp, Homo sapiens; identical to SEQ ID NO: 200686
  misc_feature: GYAE6OF01CH86L.21.46.E02.1.454.CMB.1.raw
  modified_base (243)..(245): a, c, t, g, unknown or other
  misc_feature (243)..(245): n is a, c, g, or t

SEQ ID NO: 200706 - DNA, 538 bp, Homo sapiens
  misc_feature: GYAE6OF01CNWEL.21.46.E02.1.454.CMB.1.raw
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatatgcttatggtaccaacagaagccaggccaggcccctgtgttagtgatataataaagacactgagaggccctcagagactccctgagcgattctctggctccagcctcgaggggacagcagtcacgttgactatcagtgaagtccaggcaagaggacgaggctaggactattactgtacaaanagtaagacaggtagaggttactacgtagttgggtgttcgggcggagggtaccaaaggtctacggacccggtaccgtaggtacgacggacccaagggccctcggccccccgttacgg

SEQ ID NO: 200707 - DNA, 542 bp, Homo sapiens
  misc_feature: GYAE6OF01CAAQZ.21.46.E02.1.454.CMB.1.raw
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagaggccctcagagactccctgagcgattctctggctccagctcgagggacagcagtcacgttgactatcagtgaagtccaggcaggaggacgaggctgactattactgtacaaanagtaagacgaagtagaggtactgtagttgggtgttacgggcgggagggaccgaaggtccgtacggtacccgttccgtacggtacgacgaccccgaagggtcctccggccccccgttaccggg

SEQ ID NO: 200708 - DNA, 246 bp, Homo sapiens; identical to SEQ ID NO: 200672
  misc_feature: GYAE6OF01CC48Z.21.46.E02.1.454.CMB.1.raw
  modified_base (243)..(246): a, c, t, g, unknown or other
  misc_feature (243)..(246): n is a, c, g, or t

SEQ ID NO: 200709 - DNA, 245 bp, Homo sapiens
  misc_feature: GYAE6OF01B2ICV.21.46.E02.1.454.CMB.1.raw
  modified_base (242)..(245): a, c, t, g, unknown or other
  misc_feature (242)..(245): n is a, c, g, or t
tcagtcgtcgctcgcacgaccggtgctcgatttagactcatctacagggaaagggactggagtggttattattcctggggccagggaaccctggtaaccgtctcctcagcctccaccaaggcccatcggtcttcccctggcgccctgctccaggagcacctccgagagcacagcggccctgggctgcctggtcaaggactacttcccgagcgacgactgagcgggctggcaaggcgcatagnnnn

SEQ ID NO: 200710 - DNA, 521 bp, Homo sapiens
  misc_feature: GYAE6OF01DGW8J.21.46.E02.1.454.CMB.1.raw
  modified_base (243)..(243): a, c, t, g, unknown or other
  misc_feature (243)..(243): n is a, c, g, or t
  modified_base (372)..(372): a, c, t, g, unknown or other
  misc_feature (372)..(372): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctcggtgtcagtgtccccaggacagacggccaggatcacctgctctgcagatggactgaccaaaagaaatntgcttattggtaccaacagaagccaggccaggcccctgtgttagtgatatataaagacactgagaggccctcagagatccctgagcgattctctggctccagctcgagggcagcagtcacgttgactancagtgaacgtcgaggacagaggacgaggcgtagacttattacgtgtacaanagtagacagtagagtactntagttggtcgttcgggcggagggacaaggtcgtacggacccgtcgtaggtcacgaccgaaggcctccggccccgttcgg

SEQ ID NO: 200711 - DNA, 576 bp, Homo sapiens
  misc_feature: GYAE6OF01EMTYT.21.46.E02.1.454.CMB.1.raw
  modified_base (258)..(258): a, c, t, g, unknown or other
  misc_feature (258)..(258): n is a, c, g, or t
  modified_base (314)..(314): a, c, t, g, unknown or other
  misc_feature (314)..(314): n is a, c, g, or t
  modified_base (344)..(344): a, c, t, g, unknown or other
  misc_feature (344)..(344): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatccacctgctctgcagatggactgaccaaagaaatatgcttatggtaaccaanagaagccaggccaggcccctgtgttacgtgatatataaagacactgagaggccctnagagactccctgagcgattctctggctccngctcgaggacagcagtcacgttgactatcagtgaagtcaggcagaggacgagctgacttatacgtagtacaaacagtaacgacaggtaagtaacgggttaactacgtagtttggggtagttccggggacggtaacgggtaaccgtaaaggtcgttacgggtacccggttacccgttaaggggtacccaacggaccccgaaaggggtcccttcccggccccccggttaccggg

SEQ ID NO: 200712 - DNA, 500 bp, Homo sapiens
  misc_feature: GYAE6OF01EQ2NS.21.46.E02.1.454.CMB.1.raw
  modified_base (412)..(412): a, c, t, g, unknown or other
  misc_feature (412)..(412): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtcaggcagagacgaggctgactattactgtacaaanagtagacagtagaggtactcagttgggtgttcggcggagggaccgaaggctggaccgtcctaggtcaggcccaaggctgccccctcgg

SEQ ID NO: 200713 - DNA, 516 bp, Homo sapiens
  misc_feature: GYAE6OF01EV1ZH.21.46.E02.1.454.CMB.1.raw
  modified_base (312)..(312): a, c, t, g, unknown or other
  misc_feature (312)..(312): n is a, c, g, or t
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctctgcagatggactgaccaaagaatatgcttatggtaccaacagaagccaggccaggcccctgtgttagtgatatataaagacactgagaggccctnagagatccctgagcgtattctctggcctccagctcgagggacagcagtcacgttgactatcagtgaagtccaggcagaggacgaggctgactaattactagtacaaanagtaagacagtagaggtactctagttgggtgttcggcggaagggaccgaagctaggaccgtccgtaggccacggcccaaggcctcgcccccgtcgg

SEQ ID NO: 200714 - DNA, 245 bp, Homo sapiens; identical to SEQ ID NO: 200686
  misc_feature: GYAE6OF01BCR80.21.46.E02.1.454.CMB.1.raw
  modified_base (243)..(245): a, c, t, g, unknown or other
  misc_feature (243)..(245): n is a, c, g, or t

SEQ ID NO: 200715 - DNA, 510 bp, Homo sapiens
  misc_feature: GYAE6OF01AETYZ.21.46.E02.1.454.CMB.1.raw
  modified_base (416)..(416): a, c, t, g, unknown or other
  misc_feature (416)..(416): n is a, c, g, or t
tcagtcgtcgctcgcacgaccggtgctcgatttagactcatctacagggaaagggggtgggtccaggaggcagaactctgggtgtctcaccatggcctggatccctctacttctccctctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctcagagactccctgagcgattctctggctccagctcgagggacagcagtcacgttgactatcagtgaagtcaggcagaggacgaggctagactatactgtacaaanagtagacagtagagtactcagttgggtgttcggacggagggaccaagcgtgacccgtcgtacgggtcacggacccaaggtcctcggtccccccg

SEQ ID NO: 200716 - DNA, 501 bp, Homo sapiens
  misc_feature: GYAE6OF01DESSG.21.46.E02.1.454.CMB.1.raw
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagngacgnggctgactattactgtacaaatagtagacagtagagtactcgagttgggtgttcggcgggagggaccaggctaggccgtcgtaggtcagacccaggctcgcccccgtcgg

SEQ ID NO: 200717 - DNA, 247 bp, Homo sapiens
  misc_feature: GYAE6OF01A1P4A.21.46.E02.1.454.CMB.1.raw
  modified_base (186)..(186): a, c, t, g, unknown or other
  misc_feature (186)..(186): n is a, c, g, or t
  modified_base (243)..(247): a, c, t, g, unknown or other
  misc_feature (243)..(247): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggtnctcggtcgagacgtacttcctccgtctctactgagcgggcgtgcgagacggcatagnnnnn

SEQ ID NO: 200718 - DNA, 512 bp, Homo sapiens
  misc_feature: GYAE6OF01DQ9NG.21.46.E02.1.454.CMB.1.raw
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctacagagatccctgagcgattctctggctcagctcagggacagcagtcacgttgactatcagtgaaagtccaggcagaggacgaggctgactattacngtacaaanagtagacagtagaggttactcagttgggtgttcgggacggtagggaccgaagctagacccgtccgtaggtacacgacccaggcctcgccccgtcgg

SEQ ID NO: 200719 - DNA, 628 bp, Homo sapiens
  misc_feature: GYAE6OF01DZNEK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgacttattggtaaccaacagaagccaggccaggcccctgtgttagtgatatataaagacactagagacggcctcagagactccctgagcgattctctggcctcagctcgacgggacagcagtcacgttagactatcgagtagaagtaccgaggacaggaggacggaggtctagtaacttattacgtagtaaccaaagtaagtaagaacgtaagtaaggtacgttaacgtacgttaaggtttcggggtacggttttcggggacggggtaacgggaaacccggtaacggtaccgttaccggtaacccggttacccgggttaaacgggtaccgtaaccggacccccggtaaacgggtccccgtacccggtcccccccgggtttaccccggg

SEQ ID NO: 200720 - DNA, 522 bp, Homo sapiens
  misc_feature: GYAE6OF01CQ2TC.21.46.E02.1.454.CMB.1.raw
  modified_base (313)..(313): a, c, t, g, unknown or other
  misc_feature (313)..(313): n is a, c, g, or t
  modified_base (391)..(391): a, c, t, g, unknown or other
  misc_feature (391)..(391): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataagacactgagaggccctnaagagactcccgtagagcgtattctctggctccagctcgagggcagcagtcacgttgactatcagtgaagtccagganaggaggacgaggctagacttattactgtacaactagtaagacgaagtagagtactacgtagttgggtgtcggcgggaggaccgaagctacggaccgtcgtaggtcacggacccaggcctcgcccccgtcgg

SEQ ID NO: 200721 - DNA, 558 bp, Homo sapiens
  misc_feature: GYAE6OF01EP5RR.21.46.E02.1.454.CMB.1.raw
  modified_base (314)..(314): a, c, t, g, unknown or other
  misc_feature (314)..(314): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccctgtgttagtgatataataaagacactgagacggccctanagagactccctagacgcgtattctctggctccagctcgagggacagcagtcacgttgactatcagtgaagtcaggcaggaggacgagctagacttatactgacaaacgngtaagacgtagtaagaaggttactacgtaggttgggttacggttcggacgggtaacgggtaaccgtaagtcgtacggacccgttaccgtacggtccgtaacggacccgtaaaggccgtccgtcccccgttaccgg

SEQ ID NO: 200722 - DNA, 245 bp, Homo sapiens; identical to SEQ ID NO: 200686
  misc_feature: GYAE6OF01EJZRW.21.46.E02.1.454.CMB.1.raw
  modified_base (243)..(245): a, c, t, g, unknown or other
  misc_feature (243)..(245): n is a, c, g, or t

SEQ ID NO: 200723 - DNA, 508 bp, Homo sapiens
  misc_feature: GYAE6OF01ASLJY.21.46.E02.1.454.CMB.1.raw
  modified_base (453)..(453): a, c, t, g, unknown or other
  misc_feature (453)..(453): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcgagggacagcagtcacgttgactatcagtagaagtccaggcagaggacgaggctgactattactgtacaaacagtagacagtagagtactcgtagttgggtgttcggnggagggacagcgtacggaccgtcgtaggtcacgcccgaaggcctcgccccgtcgg

SEQ ID NO: 200724 - DNA, 552 bp, Homo sapiens
  misc_feature: GYAE6OF01B54AY.21.46.E02.1.454.CMB.1.raw
  modified_base (419)..(419): a, c, t, g, unknown or other
  misc_feature (419)..(419): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagatccctgagcgattctctggctccagctcgagggacagcagtcacgttgactatcagtgaagtcgaagcagaggacgaggctagactattactagtacaaanagtaagacagtaagaggttactacgtagttgggtcgttacgggcgggaaggggtaccgaaaggtcgtacggacccggttaccgtaaggttccgacggtaccccgaaaggcccgttcggtccccccgttccggg

SEQ ID NO: 200725 - DNA, 509 bp, Homo sapiens
  misc_feature: GYAE6OF01BGNBX.21.46.E02.1.454.CMB.1.raw
  modified_base (311)..(311): a, c, t, g, unknown or other
  misc_feature (311)..(311): n is a, c, g, or t
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcagggacagcagtcacgttgactatcagtgaagtccaggcagaggacgaggctgactattactgtacaaacngtagacagtagaggtactcgagttgggtgttcggcgggagggaccaaggctaggacccgtccgtaggtcagcccaaggcctcggcccccgtcgg

SEQ ID NO: 200726 - DNA, 510 bp, Homo sapiens
  misc_feature: GYAE6OF01B9G81.21.46.E02.1.454.CMB.1.raw
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtcccaggcagaggacgaggctgactattactgtacaacngtagacagtagaggtactcagttgggtgttcgggcggagggaccaaggctaggacccgtccgtaggtcaggcccaaggcctcggcccccgtcggg

SEQ ID NO: 200727 - DNA, 510 bp, Homo sapiens
  misc_feature: GYAE6OF01D3L98.21.46.E02.1.454.CMB.1.raw
  modified_base (433)..(433): a, c, t, g, unknown or other
  misc_feature (433)..(433): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggcctcagagatccctgagcgattctctggctccagctcagggacagcagtcacgttgactatcagtgaagtcaggcagaggacgaggctgactattactgtacaacagtaagacagtagaggttacncgtagttgggtgttcgggcggagggaccaaggctaggacccgtcgtaggccgagcccgaaggcctcgcccccgtcgg

SEQ ID NO: 200728 - DNA, 624 bp, Homo sapiens
  misc_feature: GYAE6OF01CP22M.21.46.E02.1.454.CMB.1.raw
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacgaccaggatcacctgctctgcagatggactgaccaaagaatatgcttattggaaccaacagaacgccaggccaggcccctgtgtagtgatatataaagcacgtgagacggccctanagagactccgngagcgtattctctggctccagcctgaggacagcagtcacgttgactatcagtagaacgtccgaggacaggacggacgaggctagtaactagttacgtagtaaccaaacgtaggtaacgaacgtaaggttaaggtaacggttaccttacgttagggtttacggggttaggttaccgggggaccggggtaacgggtaaacccgtaacgggtaccgttacgggtaaccccggttaccggttaacgggttaccgaaccgggtaccccgaaacgggtcccctccgggtcccccccggtttaccggg

SEQ ID NO: 200729 - DNA, 501 bp, Homo sapiens
  misc_feature: GYAE6OF01D7RCO.21.46.E02.1.454.CMB.1.raw
  modified_base (462)..(462): a, c, t, g, unknown or other
  misc_feature (462)..(462): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaaagacactgagaggccctcagagatccctgagcgattctctggctccagctcagggacagcagtcacgttgactatcagtgaagtcaggcagaggacgaggctgactattactgtacaaacagtagacagtagaggtactacattgggtgttcggcggagggaccaagcnggtaccgtccgtaggtcagcccaaggcctgccccctcgg

SEQ ID NO: 200730 - DNA, 518 bp, Homo sapiens
  misc_feature: GYAE6OF01B25I1.21.46.E02.1.454.CMB.1.raw
  modified_base (320)..(320): a, c, t, g, unknown or other
  misc_feature (320)..(320): n is a, c, g, or t
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtcgtccccaggacagaccggccaggatccacctgctctgcagatggactgaccaaagaaatatgcttattggtaccaacagaagccaggccaggcccctgtgttagtgatataataaagacactgagacggccctnagagactcccctgagcgattctctggcctccagctcgaggggacagcagtccgacgttgactatcagtgaacgtccaggcaggaggacgaggctagacttattactgtacaanagtagacagtagagtacngagttggtgttcggcgggaggaccgagctaggccgtcgtaggtcacgccgaaggcctcgcccctcgg

SEQ ID NO: 200731 - DNA, 529 bp, Homo sapiens
  misc_feature: GYAE6OF01BF2QV.21.46.E02.1.454.CMB.1.raw
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (372)..(372): a, c, t, g, unknown or other
  misc_feature (372)..(372): n is a, c, g, or t
tcagtcgtcgctcgcacgaccggtgctcgatttagactcatctacagggaaaggggtgggtccaggaggcagaactctgggtgtctcaccatggcctggatccctctacttttccccctcctcactctctgcacaggctctgaggcctcctatgagctgacacagccaccctcggtgtcagtgtccccaggacagacggccaggatcacctgctctgcagatggactgaccaaaagaatatgcttagttggtaaccaacagaagccaggccaggcccctgtgttagtgatataataaagacactgagagccctnagagatccctgagcgtattcngtggctcgagctcgaggacagcagtcacgttgactancagtagaagtccgaggacaggaggacgagctagaactattactgtacaaacgtagtagacagtagtagtactgaagttggtcgttaggcggacggacgaagccgtaggacccgtgtacggtacacggacccgaaggcgtccgtcccccgtgtacccg

SEQ ID NO: 200732 - DNA, 532 bp, Homo sapiens
  misc_feature: GYAE6OF01D10HS.21.46.E02.1.454.CMB.1.raw
  modified_base (313)..(313): a, c, t, g, unknown or other
  misc_feature (313)..(313): n is a, c, g, or t
  modified_base (413)..(413): a, c, t, g, unknown or other
  misc_feature (413)..(413): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatataataaagacactgagaggccctnagagatccctgagcgattctctggctcagctcagggacagcagtcacgttgactatcagtgaagtcaggcagaggacgaggctgactatactgtacaaangtaagacagtagaggtactcgtagttgggtgttcgggacggagggaccgtaaggcgtaggacccggtcccgtaaggtccgaacggccccgaaagggtcctccggccccccgttaccggg

SEQ ID NO: 200733 - DNA, 508 bp, Homo sapiens
  misc_feature: GYAE6OF01B985T.21.46.E02.1.454.CMB.1.raw
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttatggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaanagtanacgagtagaggtactcagttgggtgttcggcggaggaccaaggctaggacccgtcgtaggtcacggacccaaggcctcgcccccgtcgg

SEQ ID NO: 200734 - DNA, 547 bp, Homo sapiens
  misc_feature: GYAE6OF01EWKN1.21.46.E02.1.454.CMB.1.raw
  modified_base (325)..(325): a, c, t, g, unknown or other
  misc_feature (325)..(325): n is a, c, g, or t
  modified_base (460)..(460): a, c, t, g, unknown or other
  misc_feature (460)..(460): n is a, c, g, or t
tcagtcgtcgctcgcacgaccggtgctcgatttagactcatctacagggaaagggggtgggtccaggaggcagaactctgggtgtctcaccatggcctggatccctctacttttccccctcctcactctctgcacaggctctgaggcctcctatgagctgacacagccaccctcggtgtcagtgtccccaggacagacggccaggatcacctgctctgcagatggactgaccaaaagaaatatgacttattcggtaaccaacagaagccaaggccacggccctgtagttagtagataataataaagacacgtgagacggccctanagagactcccgtagacgcgtattctcgtcggctccgagctacgacggacagctagtcacgttagactatcgagtagaactaccgaggacaaggaggacgaggctagtacttaattactagtaacaagagtaaganagtagagtactgagttgggtgtcgggaggacggacaagcgtacggacgtccgtaggtcacgacccgaaggcctccgccccgtggtcc

SEQ ID NO: 200735 - DNA, 503 bp, Homo sapiens
  misc_feature: GYAE6OF01BCITJ.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctnagagatccctgagcgattctctggctccagctcagggacagcagtcacgttgactatcagtgaagtccaggcagaggacgaggctgactattactgtacaaacagtagacagtagagtactcattgggtgttcggcggagggaccgaaggctaggccgtccgtaggctagcccaaggctcggccccctcgg

SEQ ID NO: 200736 - DNA, 514 bp, Homo sapiens
  misc_feature: GYAE6OF01BNWL7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggccctcagagatccctgagcgattctctggctccagctcgagggacagcaagtcacgttgactatcagtgaagtcaggcagaggacgaggctgactattactagtacaaacagtagacagtagagtactacgagttgggtgttcggacggagggaccgaagcgtagcccgtacgtaggcacggacccgaaggcctcgcccccgttcgg

SEQ ID NO: 200737 - DNA, 514 bp, Homo sapiens
  misc_feature: GYAE6OF01AC7GX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctcgagagactccctgagcgattctctgcctccagctgacgggacagcagtcacgttagactatcagtgaacgtccgaggcagagacgaggctgactagttactcgtacaaacgagtaacacgagtagacggtactatggtggtcggtggacggacgagtcgagtccgctacgcgacgaccgacgacgccgtcccgcgttaccgg

SEQ ID NO: 200738 - DNA, 493 bp, Homo sapiens
  misc_feature: GYAE6OF01CH9FU.21.46.E02.1.454.CMB.1.raw
  modified_base (284)..(284): a, c, t, g, unknown or other
  misc_feature (284)..(284): n is a, c, g, or t
  modified_base (414)..(414): a, c, t, g, unknown or other
  misc_feature (414)..(414): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagngatatataaagacactgagaggccctcagagatcccctgagcgattctctggctccagctcagggacagcagtcacgttgactatcagtgaagtccaggcagaggacgaggctgactattactgtacaangtagacagtagaggtactcagttggtgttcggcggagggaccaggctgccgtctaggtcagcccaaggctgcccctcgg

SEQ ID NO: 200739 - DNA, 514 bp, Homo sapiens
  misc_feature: GYAE6OF01BT8LI.21.46.E02.1.454.CMB.1.raw
  modified_base (311)..(311): a, c, t, g, unknown or other
  misc_feature (311)..(311): n is a, c, g, or t
  modified_base (364)..(364): a, c, t, g, unknown or other
  misc_feature (364)..(364): n is a, c, g, or t
  modified_base (417)..(417): a, c, t, g, unknown or other
  misc_feature (417)..(417): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctnagagatccctgagcgattctctggctccagctcgagggacagcagtcacgttnactatcagtgaagtccaggcagaggacgaggctgactattactgtacaaacgngtaagacagtagagtactacgattgggtgttcgggcggagggaccgaaggctaggaccgtaccgtaggtcacgacccaaggcctcggcccctaccgg

SEQ ID NO: 200740 - DNA, 515 bp, Homo sapiens
  misc_feature: GYAE6OF01BZVHG.21.46.E02.1.454.CMB.1.raw
  modified_base (314)..(314): a, c, t, g, unknown or other
  misc_feature (314)..(314): n is a, c, g, or t
  modified_base (418)..(418): a, c, t, g, unknown or other
  misc_feature (418)..(418): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaaacagaagccaggccaggccccctgtgttagtgatatataaagacactgagaggccctnagagatccctgagcgattctctggctccagctcgagggacagcagtcacgttgactatcagtgaagtccaggcagagacgaggctgactattactgtacaaacngtagacagtagagtactcgagttgggtgttcgggcggtagggaccgaaggtctaggacccgtcctaggtcagacccgaaggctcggcccccgtcggg

SEQ ID NO: 200741 - DNA, 525 bp, Homo sapiens
  misc_feature: GYAE6OF01C9L5K.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctnagagatccctgagcgattctctggctcagctcagggacagcagtcacgttgactatcagtgaagtccaggcagaggacgaggctgactattactgtacaaacgagtagacagtagaggttactcgagttgggtgttcggcgggtagggaccgaaggctacggacccgtacgtacggtcgacgacccgaagggcctcggtccccccgtaccggg

SEQ ID NO: 200742 - DNA, 542 bp, Homo sapiens
  misc_feature: GYAE6OF01C3TAZ.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgaatataataaagacactgagaggccctnagagatcccgtgagcgattctctggctcagctcgagggacagcagtcacgttgaactatcagtgaagtccaaggcaaggaggacgaggctagactattactagtacaaatagtaagaacgaagtaggaggttactacgtagtttgggtgttacggacgggtaggaccgaaggctacggacccgtccgtaggtccaacggtaccccaaggcctccgcccccgttacgg

SEQ ID NO: 200743 - DNA, 246 bp, Homo sapiens
  misc_feature: GYAE6OF01ALOTW.21.46.E02.1.454.CMB.1.raw
  modified_base (243)..(246): a, c, t, g, unknown or other
  misc_feature (243)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccggcgacgactgagcgggctggcaaggcgcatagnnnn

SEQ ID NO: 200744 - DNA, 245 bp, Homo sapiens
  misc_feature: GYAE6OF01CBBM2.21.46.E02.1.454.CMB.1.raw
  modified_base (243)..(245): a, c, t, g, unknown or other
  misc_feature (243)..(245): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcccgagcgacgactgagcgggctggcaaggcgcatagnnn

SEQ ID NO: 200745 - DNA, 532 bp, Homo sapiens
  misc_feature: GYAE6OF01CD1FR.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgcttattggtaccaacagaagccaggccaggcccctgtgttagtgatatataaagacactgagaggccctcagagatccctgagcgattctctggctcagctcagggcagcagtcacgttgactatcagtgaagtccaggcagaggacgaggctagactattactgtacaacagtaagacagtagaggtactcgagttgggtgttcgggacgggacgggaccgaaggtctacggacccggttcgtagggtccgacggaccccgaagggcctccggccccccgttacggg

SEQ ID NO: 200746 - DNA, 682 bp, Homo sapiens
  misc_feature: GYAE6OF01C1OC0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaaagaatatgacttataggtaccaacagaagccaggccacggcccctgtgttagtgaatataataaagacactagagacgccctacgaagagactccctgacgtcgtaacttccgtacgtcggccttccgagtcctacgaaggggaaccaggtaccgacgttaccgaacggtttacgaaccgttaagtaccgtaagggttacgtaaacgtacccggaagggacgaagggaacgggaaccgggtagggtaccgttacggaactttaagttaaccggttagtaaccgtaaaacgtaaggttaacgaaccgtaaaggttacggtaaacggttaaccgttacgtaaggtttcggggttaggttaccgggacggggttaacgggaacccgtaacggccgtacggcccgttacgtacggtccacggacccgaaggcccgtccgcccccgttacgg

SEQ ID NO: 200747 - DNA, 560 bp, Homo sapiens
  misc_feature: GYAE6OF01BP0JD.21.46.E02.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaagacactgagacggccctanagagactccctgagcgtattctctggctccagctcgagggacagcagtcacgttgactatcagtgaagtccaggcaaggaggacgaggctagacttattactagtaccaaagtagtaagactaggtagaggttactacgtagtttgggtaggttcgggacgggaacgggaccgaaggtcgtacggtacccggtacgtaacggacgtacggaccccgaagggccctacccggcccccgttaccgg

SEQ ID NO: 200748 - DNA, 506 bp, Homo sapiens
  misc_feature: GYAE6OF01BK8N7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctcagagatccctgagtgattctctggctccagctcagggacagcagtcacgttgactatcagtgaagtccaggcagaggacgaggctgactattactgtacaacagtagacagtagaggtactgtattgggtgttcggcggagggaccaaggctaggcccgtcgtaggtcagacccaaggcctcggcccccgtcgg

SEQ ID NO: 200749 - DNA, 506 bp, Homo sapiens
  misc_feature: GYAE6OF01CY6BB.21.46.E02.1.454.CMB.1.raw
  modified_base (294)..(294): a, c, t, g, unknown or other
  misc_feature (294)..(294): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttaattggtaccaacagaagccaggccaggcccctgtgttagtgatatanaaagacactgagaggccctcagagatcccctgagcgattctctggctccagctcagggcagcagtcacgttgactatcagtgaagtccaggcaggagacgaggctgactattactntacaanagtanacagtagaggtactgattgggtgttcgggcggagggaccaaggctaggacccgtctaggtcaggacccaaggctcgccccgtcgg

SEQ ID NO: 200750 - DNA, 547 bp, Homo sapiens
  misc_feature: GYAE6OF01BJCN8.21.46.E02.1.454.CMB.1.raw
  modified_base (285)..(285): a, c, t, g, unknown or other
  misc_feature (285)..(285): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagngatatataaagacactgagaggccctcagagactccctgagcgattctctggctccagctcgagggacagcagtcacgttgactatcagtgaagtccaggcaaggacggacgaggctagtactattactgtacaaagagtagacagtagaggttactagtagttgggtagttcgggacgggaagggaccgaaggtcgtacggtacccggtaccgtaagggtccgaacgaccccgaaggtccctcccggcccccgttaccggg

SEQ ID NO: 200751 - DNA, 865 bp, Homo sapiens
  misc_feature: GYAE6OF01CI8F3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccgaggacacggacggccaggatccacctgctctgcagatggactgaccaaaagaatatgtacttagttacggtaaccaacgagaaacgccgaacggcccacggccccttaggttggttaagtagaacttaattaaagtaaaagacctaacgtaggaacggacggtacccctagaaggacgtactcccgtaggagtccgtatttcctcgtcggaccctaccgaacgtccgtacggaaggggaccaacggtcctaagggtacctaacgggttacgtaaccgtaagttaccgtaaggttacgaaacgggttacccgaacgggaccggaaagggacgggaacgggtaacgggtaccgttaacggtaaccgtttaacgtttaaaccgttacggtaaacccgtaaaacgtaacgggtaaacggtaacggtaaaacgggttaacgggtaacggtttaacccgttaaggtttaacggggttttcggggggttaaccggggttaccgggggtaacccggggtaaacgggggtaaaccccgtaacgggttaacccgggttacccgggttaaaccccgggtttaaccccgggttaacggggttaaccccggaaacccgggtaaccccccgggtaaacggggttcccccgttacccccggggttacccccccccggtttacccgggg

SEQ ID NO: 200752 - DNA, 524 bp, Homo sapiens
  misc_feature: GYAE6OF01BOA5F.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtcgttagtgatatataaagacactgagacggccctnagagactccctgacgcgtattctctggcctcagctacgagggacagcagtcagttgactatacagtagaagtccgaggcagaggacgagctgacttatactgtacaagagtagacagtagagtactagtagttggtggttacggcggtaggaccgaagcgtaggacccgttcgtaggtcgacgtcccgaaggcctccgtcccccgtacgg

SEQ ID NO: 200753 - DNA, 528 bp, Homo sapiens
  misc_feature: GYAE6OF01D4Q0V.21.46.E02.1.454.CMB.1.raw
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatatgcttattggtaccaacagaagccaggccaggcccctgtgttagtgatataataaagacactgagacggccctcgagagactccctgacgcgattctctggcttccagctcgagggacagcagtcgacgttgactagtacagtgaagtccaggacaggaggacgaggctgactattactgtacaanagtagacgagtagagtactntagttgggtgttcggcggaggaccgaaggtctacggaccgttacgtaggtcaacggcccaaaggcctccgccccgtaccgg

SEQ ID NO: 200754 - DNA, 536 bp, Homo sapiens
  misc_feature: GYAE6OF01CRXSL.21.46.E02.1.454.CMB.1.raw
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
  modified_base (455)..(455): a, c, t, g, unknown or other
  misc_feature (455)..(455): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaaccaacagaagcaggccaggcccctgtgtagtgatatataaagacactgagnggccctcaganatccctgagcgattcnctggctcagctnagggcagcagtcacgttgactatcagtgaagtcaggcagaggacgaggntgactattactagtacaaacgagtaagacgaagtagagtactcgtagttgggtgttacgggnggtaagggacccgtaaggacgtcggacccggttccgtaggtaccgtacgacccgaaggtcccgtcggccccccgttaccgg

SEQ ID NO: 200755 - DNA, 568 bp, Homo sapiens
  misc_feature: GYAE6OF01BEXQS.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatataataaagacactgagacggccctnagagatccctgagcgattctctggctcagctcagggacagcagtcacgttgactatcgagtgaagtcaggcagaggacgagctgactagtactgtaccaaagacgtaagacgtaacgtaagaaggttactacgtacggtttggggtacgttccgggacggggtaacggaaccgaaggtccgtacggacccggttacccgtaaggttacccgaacgggaccccgaaagggtcccgttccggccccccggttaccgg

SEQ ID NO: 200756 - DNA, 244 bp, Homo sapiens
  misc_feature: GYAE6OF01DHKHC.21.46.E02.1.454.CMB.1.raw
  modified_base (241)..(244): a, c, t, g, unknown or other
  misc_feature (241)..(244): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggcctgggctgcctggtcaaggactacttccctgtctctactgagcgggctggcaaggcgcatagnnnn

SEQ ID NO: 200757 - DNA, 247 bp, Homo sapiens
  misc_feature: GYAE6OF01CB5L2.21.46.E02.1.454.CMB.1.raw
  modified_base (243)..(247): a, c, t, g, unknown or other
  misc_feature (243)..(247): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcccgagcgacgactgagcgggctggcaaggcgcatagnnnnn

SEQ ID NO: 200758 - DNA, 537 bp, Homo sapiens
  misc_feature: GYAE6OF01ED606.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctcagagatccctgagcgattctctggctccagctcgagggacagcagtcacgttgactatcagtgaagtccaggcaggaggacgaggctgactattactgtacaaacgagtagacagtagagtactgagttgggtgttcgggcgggtagggaacccgtaaggccttacggacccggttaccgttagggtaccacggacccgaaggcgtccggccccccgttaccgg

SEQ ID NO: 200759 - DNA, 540 bp, Homo sapiens
  misc_feature: GYAE6OF01EPIXY.21.46.E02.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtctcagtgtccccgggacaaacggccaggatcacctgctctggagatgcattgaccaaaaaattntgttttttggaccagcagaagtcaggccaggcccctgtgttggtcatccatgaggacaggagacgaccctccgggatcccctgagagattctctggctccaactcagggacgtggccacgttgattctcagtggggcccaggtggaggatgaagctgactactactgttactcagcagacagcagtggtcagtcgaggggcagttcgggcggagggaccgaggttcgaccggtccgtaggtcaggcccgaaggcctcggcccccgtcggtccacttctcgttccccgccctcccgtcccg

SEQ ID NO: 200760 - DNA, 691 bp, Homo sapiens
  misc_feature: GYAE6OF01EVXRZ.21.46.E02.1.454.CMB.1.raw
  modified_base (283)..(283): a, c, t, g, unknown or other
  misc_feature (283)..(283): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttatggtaccaacagaagccaggccaggcccctgtgttagngatataagtaaaacctacgacgtaggacgtacgaccgtacgagtaccgtacgtacgtacgacgtacgtacgttcgtcgtccgtacgtaccgtacgacggtacgacggacgacgtacgtacgttacgtacgttacgtacgtagtacgtaacgtacgtaacggtaccgacgacggaacggacgggacggtacgtacgtacgttaacgttaacgttaactaacgtaacgtaaacgtaacgtaaggtaacgtaacggtaacgtaacgtaacgttacggttacggttacgggttacgggttaccggggtaaccgggacggtaccggtaacggtaaccggtaccggttaccggtacccggtaaccggtacccggtaaccggacccggtacccggtaccccggtcccggtacccg

SEQ ID NO: 200761 - DNA, 560 bp, Homo sapiens
  misc_feature: GYAE6OF01B6BVQ.21.46.E02.1.454.CMB.1.raw
  modified_base (318)..(318): a, c, t, g, unknown or other
  misc_feature (318)..(318): n is a, c, g, or t
  modified_base (345)..(345): a, c, t, g, unknown or other
  misc_feature (345)..(345): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatatgacttattggtaaccaacagaagccaggccaggcccctgtgttagtgatataataaagacactgagaggcccctanaagagaactcccgtagaagcgtattcnctggcctccagctcgagggacagcagtcagttgactatcagtgaagtccaaggcaaggaggacgaggctagactattactgtaacaaacgagtaagacaagggtaagaggttactacgtagttagggtggttacgggcgggtaagggaccctaaggctacggtacccgtccgtaagggtcacggtacccgaagggtcctccggcccccgttacgg

SEQ ID NO: 200762 - DNA, 547 bp, Homo sapiens
  misc_feature: GYAE6OF01B52RD.21.46.E02.1.454.CMB.1.raw
  modified_base (425)..(425): a, c, t, g, unknown or other
  misc_feature (425)..(425): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaagaaatatgcttattggtaccaacagaagccaggccacggcccctgtgttagtgatataataaagacactgagacggccctacagagactcccgtgagcgtattctcgtggctccgagctcgagggacagcagtctacgttgactatcagtagaagtcccaggcaaggaggacgaggctagactattacgngtacaagagtagactagtagagtactagtagttgggtgttcgggacgggaagggaccgtaggtcgtacggtacccgttccgtaggtcgacggacccgaacggtcctccggcccccgttaccg

SEQ ID NO: 200763 - DNA, 556 bp, Homo sapiens
  misc_feature: GYAE6OF01B4UBJ.21.46.E02.1.454.CMB.1.raw
  modified_base (319)..(319): a, c, t, g, unknown or other
  misc_feature (319)..(319): n is a, c, g, or t
  modified_base (383)..(383): a, c, t, g, unknown or other
  misc_feature (383)..(383): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgacaaaagaaatatgcttattggtaaccaacagaagcaggccaggcccctgtgttagtgataataataaagacactagagacggtccctanagagactcccgtgagcgtattcctgtggctccagcctcgaagggacagcagtcacgttgactancgtagtgaagtccgaaggcaaggaggacgaggctagactattacagtaacaatagtaagacgtaagtaggagtactagtagttgggtaggttcggacgggagggaaccgagtcgacggtaccgtaccgtaggtaccgaccggaccgaaggtccctccggcccccgttaccggg

SEQ ID NO: 200764 - DNA, 498 bp, Homo sapiens
  misc_feature: GYAE6OF01C39K6.21.46.E02.1.454.CMB.1.raw
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtttcagtgtccccaggacagacggccaggatcacctgctctgcagatggactgaccaaaagaatatgcttattggtaccaacagaagccaggccaggcccctgtgttagtgatataataaagacactgagaggccctcagagactccctgagcgattctcgtggctccagctcgagggacagcagtcacgttgactatcagtgaagtcaggcagaggacgagctgactattactgtacaanagtagacagtagagtactnagttgggtgttcggaggaggacagctagaccgtcaggtcagcccaaggctcgcccgtggtac

SEQ ID NO: 200765 - DNA, 524 bp, Homo sapiens
  misc_feature: GYAE6OF01CB3CK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatcccctgagcgattctctggctcagctcagggcagcagtcacgttgactatcagtgaagtcaggcagaggacgaggctgactattactagtacaaacagtagacagtagaggtactcgagttgggtgttcgggcgggaagggaccgaaggtctaggacccggtaccgtaggtccaacggcccaagggcctcggcccccgttaccggg

SEQ ID NO: 200766 - DNA, 517 bp, Homo sapiens
  misc_feature: GYAE6OF01EMI7B.21.46.E02.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgtagtgatatataaagacactgagaggccctnagagatccctgagcgattctctggctccagctcagggacagcagtcacgttgactatcagtgaagtccaggcagaggacgaggctgactattactgtacaaacgagtaagacaagtagaaggtactcgagttgggtgttcgggcggagggaccaaggtctaggacccgtcgtaggccacggacccaaggcctcgcccccgttacgg

SEQ ID NO: 200767 - DNA, 510 bp, Homo sapiens
  misc_feature: GYAE6OF01BI4ZF.21.46.E02.1.454.CMB.1.raw
  modified_base (445)..(445): a, c, t, g, unknown or other
  misc_feature (445)..(445): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaaagacactgagaggccctcagagatcccctgagcgattctctggctccagctcagggacagcagtcacgttgactatcagtgaagtccaggcagaggacgaggctgactattactgtacaaacagtagacagtaagagtaactcattgggngttcgggcggagggaccgaaggctggaccgtacctaggtccagacccaaggcctgcccccgtcgg

SEQ ID NO: 200768 - DNA, 521 bp, Homo sapiens
  misc_feature: GYAE6OF01BSPJC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtcccaggcagaggacgaggctgactattactgtacaaacagtagacgagtagagtactcagttgggtgttcgggcggagggaccgaaggcgtcggacccggtcctagggtaccacggaccccaaggcctcggccccccgttcgg

SEQ ID NO: 200769 - DNA, 246 bp, Homo sapiens; identical to SEQ ID NO: 200672
  misc_feature: GYAE6OF01BTF1R.21.46.E02.1.454.CMB.1.raw
  modified_base (243)..(246): a, c, t, g, unknown or other
  misc_feature (243)..(246): n is a, c, g, or t

SEQ ID NO: 200770 - DNA, 523 bp, Homo sapiens
  misc_feature: GYAE6OF01ATRYC.21.46.E02.1.454.CMB.1.raw
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (339)..(339): a, c, t, g, unknown or other
  misc_feature (339)..(339): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
  modified_base (433)..(433): a, c, t, g, unknown or other
  misc_feature (433)..(433): n is a, c, g, or t
tcagtcgtcgctcgcacgaccggtgctcgatttagactcatctacagggaaagggggtggggtccgaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatntgcttattggtaccaacagaagccaggccaggcccctgtgttagtgatatataaagacactgagacggcccctnagagactccctgacgcgatttcnctgggcttaccagcctagaggggacngcaagtccacgttgactancagtgaagtccaggcaggaggacgaggctgactagttactgtacaaacngtaagacgtagtagacgtatcagttgggtgtcggacggaggaccgagcgtgaccgtcgtagtacgcgacccaaggcgtcgcccccgtcgg

SEQ ID NO: 200771 - DNA, 517 bp, Homo sapiens
  misc_feature: GYAE6OF01B7HX3.21.46.E02.1.454.CMB.1.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatntgcttattggtaccaacagaagccaggccaggcccctgtgttagtgatatataaagacactgagaggccctnagagatccctgagcgattctctggcctcagctcgagggacagcagtcacgttgactatcagtgaagtcaggcagaggacgaggctgactattactgtacaaacngtaanacagtagaggtactcgagttgggtgttacggcggagggaccgaagtcgtaggacccgtcgtaggtccgacgacccgaaggcctcgcccccgtacgg

SEQ ID NO: 200772 - DNA, 525 bp, Homo sapiens
  misc_feature: GYAE6OF01BJCBI.21.46.E02.1.454.CMB.1.raw
  modified_base (315)..(315): a, c, t, g, unknown or other
  misc_feature (315)..(315): n is a, c, g, or t
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgacttattggtaaccaacagaagccaggccaggcccctggtgtagtgatatataaagacactgagaggccctnagagactccctgagcgtattctcgtggcctccgagctcgagggacagcagtcacgttnactatacagtagaagtccgaggcaagaggacgaggctagactattactagtacaagagtagacagtagagtactgtagttggtgtacggcggaaggaccgagtcgtacgaccgtccgtaggtccacggacccaggcctccgcccccgtacgg

SEQ ID NO: 200773 - DNA, 553 bp, Homo sapiens
  misc_feature: GYAE6OF01B7OIN.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagattcattgaccaaaaagatatacttgttggttccagcagaagtcaggccaggcccctgtactggtcatccatgagccagtcgacgacacgtccgggatccctgagagtattcctctgcctccagctcgagggacaggtcgcctacttgacttatcgaggtcgggaccctagggtcggacgagtgaagctagactactagttgtacgctaacagacagtagtggtcagtcgaggggtattcgggacggagggacctaaggttcgaccgttccgttggtcacggcccaaggtccgtccggtcccccgttggtcccacttccgtccgttcccccg

SEQ ID NO: 200774 - DNA, 509 bp, Homo sapiens
  misc_feature: GYAE6OF01DE2Y8.21.46.E02.1.454.CMB.1.raw
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (465)..(465): a, c, t, g, unknown or other
  misc_feature (465)..(465): n is a, c, g, or t
  modified_base (496)..(496): a, c, t, g, unknown or other
  misc_feature (496)..(496): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgtagtgatatataaagacactgagaggccctnaganatccctgagcgattcnctggctccagctcagggacagcagtcacgttgactatcagtgaagtcaggcagaggacgagctgactattacngtacaaanagtagactagtagagtactacagttgggtgttcgggcgggagggaccgaagntacggaccgtcctaggtcgacgaccgaagcncgcccccgtacgg

SEQ ID NO: 200775 - DNA, 588 bp, Homo sapiens
  misc_feature: GYAE6OF01CZA52.21.46.E02.1.454.CMB.1.raw
  modified_base (374)..(374): a, c, t, g, unknown or other
  misc_feature (374)..(374): n is a, c, g, or t
  modified_base (379)..(380): a, c, t, g, unknown or other
  misc_feature (379)..(380): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatatgacttattcggtaaccaacagaagccaggccaggcccctgtgtagtgatataataaagacactagagacggccctacagagactccctagagcgattctcgtggctcagctacgagggacagcagtcagttnactannagtgaagtcagcaagagacgaggctagactatactgtaacaaacgagtaagactaaggtagtaacggtacgtataggttagggtcggttacggggaccgggtaagggaacccgtaagggtccgtacgggtaccccggttaccggtaacgggtaccgaaccgggtaccccgtaaaggggccccttcccgggccccccgtttacccgggg

SEQ ID NO: 200776 - DNA, 507 bp, Homo sapiens
  misc_feature: GYAE6OF01D0HYN.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtcccaggacagacggccaggatcacctgctctgcagatggactgaccaaagaaatatgcttattggtaccaacagaagccaggccaggcccctgtgttagtgatatataaagacactgagaggccctcagagatccctgagcgattctctggctccagctcagggacagcagtcacgttgactatcagtgaaagtcccaggcagaggacgaggctgactattactgtacaaacagtagacagtagaggtactcgattgggtagttcgggcggagggaccgaaaggctgacccgtcctaggcagcccaaggctcggcccctccgg

SEQ ID NO: 200777 - DNA, 550 bp, Homo sapiens
  misc_feature: GYAE6OF01D2V2H.21.46.E02.1.454.CMB.1.raw
  modified_base (425)..(425): a, c, t, g, unknown or other
  misc_feature (425)..(425): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagacggccctacgagagatccctagagcgattctctggctccagctcgaagggacagcagtcagttcgactatcagtagaagtccgaaggcaggaggacgagctagacttatactgtacaaacgngtaacgacgtagtaagtacggttactacgtagttcgggtaggttccggacgggtacggaaccgtaaggcgtacggtaccgtaccgtaggcgacggcccgaaaggtccgtccggcccccgtccggg

SEQ ID NO: 200778 - DNA, 499 bp, Homo sapiens
  misc_feature: GYAE6OF01EXGPX.21.46.E02.1.454.CMB.1.raw
  modified_base (415)..(415): a, c, t, g, unknown or other
  misc_feature (415)..(415): n is a, c, g, or t
  modified_base (433)..(433): a, c, t, g, unknown or other
  misc_feature (433)..(433): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaaggccccctgtgttagtgatatataaaagacactgagaggccctcagagatccctgagcgattctctggctccagctcagggacagcagtcacgttgactatcagtgaagtccaggcagaggacgaggctgactattactgtcaaagngtagacagtagagtactnattgggtgttcggcggagggtaccgagctgaccgtcgtaggtcagcccaaggctgcccccgtacgg

SEQ ID NO: 200779 - DNA, 512 bp, Homo sapiens
  misc_feature: GYAE6OF01BBWI4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctcagagatccctgagcgattctctggctccagctcagggacagcagtcacgttgactatcagtgaagtcaggcagaggacgaggctgactatactgtacaaacgagtagacagtaagagtactagattgggtgttcggacggagggaacgaggtactggacccgtccgtaggtcacgcccgaaggcctcgcccccgttcgg

SEQ ID NO: 200780 - DNA, 246 bp, Homo sapiens; identical to SEQ ID NO: 200672
  misc_feature: GYAE6OF01ELITA.21.46.E02.1.454.CMB.1.raw
  modified_base (243)..(246): a, c, t, g, unknown or other
  misc_feature (243)..(246): n is a, c, g, or t

SEQ ID NO: 200781 - DNA, 524 bp, Homo sapiens
  misc_feature: GYAE6OF01BKFY6.21.46.E02.1.454.CMB.1.raw
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaanagaagccaggccaggcccctgtgttagtgatatataaagacactgagaggccctnagagatccctgagcgattctctggcctcagctcgagggacagcagtcacgttgactatcagtgaagtccaggcaggaggacgaggctgacttattactgtacaaacagtaagacaagtagaggttactacgagttgggtgttcgggcggagggaccgaggtctacggaccgtccgtaggtccgacgacccgaaggcctcggcccccgtacgg

SEQ ID NO: 200782 - DNA, 543 bp, Homo sapiens
  misc_feature: GYAE6OF01EP40T.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagattccctgagcgattctctggctccagctcgagggacagcagtcacgttgactatcagtgaagtcaggacagaggacgagctgacttatactgtacaaacgagtaagacgagtagaggtactcgtagttgggtgttacgggcggaagggaaccgaacggtctacggacccgttaccgtaggttaccgacggaccccgtaagggcctcccggcccccgttaccggg

SEQ ID NO: 200783 - DNA, 495 bp, Homo sapiens
  misc_feature: GYAE6OF01EC774.21.46.E02.1.454.CMB.1.raw
  modified_base (367)..(367): a, c, t, g, unknown or other
  misc_feature (367)..(367): n is a, c, g, or t
  modified_base (476)..(476): a, c, t, g, unknown or other
  misc_feature (476)..(476): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctgagagatccctgagcgattctctggctccagctcagggacagcagtcacgttnactatcagtgaagtcaggcagaggacgaggctgactatactgtacaacagtagacagtagagtactagtagttgggtgtcggaggaggaccagtctggaccgtctagcncgaccaggctcgcccgtcg

SEQ ID NO: 200784 - DNA, 513 bp, Homo sapiens
  misc_feature: GYAE6OF01AY21Y.21.46.E02.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctnagagatccctgacgcgattctctggcctccagctcgagggacagcagtcacgttgactatcagtgaagtccaggcagaggacgaggctgactattacgtgtacaacagtagacagtagagtactacgagttgggtgttcgggacggagggaccgagcgtacggaccgtcgtaggtcacggcccaaggctccgccccgtccgg

SEQ ID NO: 200785 - DNA, 555 bp, Homo sapiens
  misc_feature: GYAE6OF01EV2I3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagactccctgagcgtaattctctggcctccgagcctcgagggacagcagtcacgttgactatcgagtgaacgtcgagcagaggacgaggctgactattctagtacaaacgtagtaacgacgtaagtagtaaggtactacgtagttgggtgttacgggacgggaacggaccgaaggtcgtacgggacccgttccgtaacggtcgtacggaccccgaaggccttccggcccccgttaccggg

SEQ ID NO: 200786 - DNA, 503 bp, Homo sapiens
  misc_feature: GYAE6OF01CWC5B.21.46.E02.1.454.CMB.1.raw
  modified_base (239)..(239): a, c, t, g, unknown or other
  misc_feature (239)..(239): n is a, c, g, or t
  modified_base (312)..(312): a, c, t, g, unknown or other
  misc_feature (312)..(312): n is a, c, g, or t
  modified_base (408)..(408): a, c, t, g, unknown or other
  misc_feature (408)..(408): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatntgcttattggtaccaacagaagccaggccaggcccctgtgttagtgatatataaagacactagagaggccctnagagatcccgtgagcgattctctggctcagctcgagggcagcagtcacgttgactatcagtgaagtccaggcagaggacgaggctagactattacngtacaacagtagacagtagagtactgagttgggtgttcgggcggagggaccaagcgtggacccgtctaggtcacgacccgagctcgccccgtcgg

SEQ ID NO: 200787 - DNA, 547 bp, Homo sapiens
  misc_feature: GYAE6OF01CJNZ9.21.46.E02.1.454.CMB.1.raw
  modified_base (240)..(240): a, c, t, g, unknown or other
  misc_feature (240)..(240): n is a, c, g, or t
  modified_base (426)..(426): a, c, t, g, unknown or other
  misc_feature (426)..(426): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgatatataagacactgagacggccctcagagactccctagagcgtattctctggctccagctcgagggacagcagtcacgttgactatcagtagaagtccgaaggcaaggacggacgaggctagactatacgtgtacaaanagtaagacaagtagaggttactgtagttgggtggtacggacgggaagggaccgaaggcgtacggaccgttccgtaaggttccgacggtaccccgaaggccgttccgccccccggttaccgg

SEQ ID NO: 200788 - DNA, 660 bp, Homo sapiens
  misc_feature: GYAE6OF01D87RY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcactgctctgcagatggactgaccaaagaaatatgtcttattcggtaaccaacagaacgccgaggcccacggcccctgtgttagtagatatataaagacacgtagacgacgccctagagagactccctgacgtcgtattctactcggctccagtcctacggacggacagcgacgtcgacgttgactatcgaagtagaacgtccgaagggtacgaaggaacgggacggtacggcttacggtaaccttagttaccgttagaacgtaaaaccgtaggttaacgaaccgtaagggtaacggtaacgggtttactacggttaagggtttcgggttacggtttaccggggacggggtaacgggtaaccgaacggtcgtaccggtaaccccggttcgttaaccgggtaccaaccgggtaccccgtaaggtccccgttacccggtccccccgttacccggg

SEQ ID NO: 200789 - DNA, 656 bp, Homo sapiens
  misc_feature: GYAE6OF01CQMC9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccaccctcggtgtcagtgtccccaggacagacggccaggatcacctgctctgcagatggactcgacaaaagaatatgacttattggtaaccaacagaagccaggccaggcccctgtgttagtgatataataaagacactgagacgcctagagacgactcccgtagagtcgtaatttccgtacgtggcctccgagtcctacgaacggggacacggtaccgaaggttccaacggtttcgaacttactaccgtaagttacgaaacggttaccgaacgggaccgaagggaagggaacggaagggtcctaggaaactttacgttaacgttaggtaaaccgaaagtacggtaacgaacgtaaggtaaggtagttaacgttacgtaggttggggttacggttcgggacggggtacggaaccgaggaccggttacggacccggttacccgtaaggtccgacggtacccgaagggtccctcccggtcccccgtacggg

SEQ ID NO: 200790 - DNA, 247 bp, Homo sapiens; identical to SEQ ID NO: 200757
  misc_feature: GYAE6OF01A4AMI.21.46.E02.1.454.CMB.1.raw
  modified_base (243)..(247): a, c, t, g, unknown or other
  misc_feature (243)..(247): n is a, c, g, or t

SEQ ID NO: 200791 - DNA, 538 bp, Homo sapiens
  misc_feature: GYAE6OF01AQA5G.21.46.E02.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgccaaaagaaatatgcttattggtaaccaacagaagccaggccacggcccctgtgttagtgatataataaagacactgagacggccctnagagatccctgagcgtattctcgtggctccagtctcgaacgggacagcagtcacgttgactatcagtagaagtccaggcagacggagaggctagactattactgtacaaacgtgtaagacgagtagagtactagtagttgggtgtcgggacggaggaccgaaggtcgtacggacccgtcgtaggtacgacgacccgtaaggccgtccggtcccccgtcgg

SEQ ID NO: 200792 - DNA, 522 bp, Homo sapiens
  misc_feature: GYAE6OF01A9CF9.21.46.E02.1.454.CMB.1.raw
  modified_base (312)..(312): a, c, t, g, unknown or other
  misc_feature (312)..(312): n is a, c, g, or t
  modified_base (374)..(374): a, c, t, g, unknown or other
  misc_feature (374)..(374): n is a, c, g, or t
  modified_base (426)..(426): a, c, t, g, unknown or other
  misc_feature (426)..(426): n is a, c, g, or t
  modified_base (466)..(466): a, c, t, g, unknown or other
  misc_feature (466)..(466): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttattggtaaccaacagaagccaggccaggcccctgtgttagtgatatataaagacactgagaggccctnagagactccctgacgcgattctcgtggcctccgagctcgagggacagcagtcacgttgactntcagtgaagtcaggcaggacggacgaggctgactattacgtagtacaaacgngtaagacgagtagagttactctagttacgggtgttcgggnggaagggaccagcgtcggaccgtcgtaggtcacgacccgaagcctcgccccgtcgg

SEQ ID NO: 200793 - DNA, 523 bp, Homo sapiens
  misc_feature: GYAE6OF01A3D7S.21.46.E02.1.454.CMB.1.raw
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgtagtgatatataaagacactgagaggccctnagagatccctgagcgattctctggctccagctcgagggacagcagtcacgttgactatcagtnagtccaggcagaggacgaggctgactattactgtacaaacagtaagacgagtagagtactcagttgggtgttcgggcggtagggaccgaagccgtaggtacccgtccgtagggtccacggaccccgtaaggcctcgccccccgttaccgg

SEQ ID NO: 200794 - DNA, 505 bp, Homo sapiens
  misc_feature: GYAE6OF01BNYRY.21.46.E02.1.454.CMB.1.raw
  modified_base (434)..(434): a, c, t, g, unknown or other
  misc_feature (434)..(434): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagaggtactnagttgggtgttcggcggagggaccgaggtctaggaccgtccgtaggtcagcccaaggctcgcccccgtcgg

SEQ ID NO: 200795 - DNA, 559 bp, Homo sapiens
  misc_feature: GYAE6OF01ECEL9.21.46.E02.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgcttattggtaccaacagaagccaggccaggcccctgtgttagtgatatataaagacactgagacggccctnagagatccctgagcgattctcgtggcctcagctcgagggacagcagtcacgttgactatcagtagaagtccgagcaggaggacgaggctagacttagttactagtaacaaacgtagtaagacgtaaggtagacggttactgtaggttgggttaggttcgggacgggaagggaaccgaggtcgtacggtacccgtccgtacgggaccgtacggacccgaaggtcctcccggcccccgttccggg

SEQ ID NO: 200796 - DNA, 544 bp, Homo sapiens
  misc_feature: GYAE6OF01DQM6F.21.46.E02.1.454.CMB.1.raw
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctgagcgattctctggctccagctcgagggacagcagtcacgttnactancagtgaagtccgaggcaggaggacgaggctgaacttattactagtacaaacgtagtagacaggtagaggttactagagttgggtcggttcgggcgggaagggaccgaaaggtccgtacggacccgtacgtacggtacgtacggacccgaaggcctccggcccccgttaccggg

SEQ ID NO: 200797 - DNA, 561 bp, Homo sapiens
  misc_feature: GYAE6OF01B3FTP.21.46.E02.1.454.CMB.1.raw
  modified_base (333)..(333): a, c, t, g, unknown or other
  misc_feature (333)..(333): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctacagagatccctgagcgattcnctggctcagctcagggacagcagcacgttgactatcagtgagtcaggcaagaggacgaggctagactaattactagtacaaacagttaagacgtaagtagaaggttactagtagttggggtgtttacgggacgggtaagggaaccgaggtaccgtacggacccggttaccgtaaggggttacccacggaccccgtaaagggcccgttccgtccccccggttacccggg

SEQ ID NO: 200798 - DNA, 517 bp, Homo sapiens
  misc_feature: GYAE6OF01A7E6G.21.46.E02.1.454.CMB.1.raw
  modified_base (313)..(313): a, c, t, g, unknown or other
  misc_feature (313)..(313): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggccctnagagatccctgagcgattctctggctccagctcgagggacagcagtcacgttgactatcagtgaacgtccaggcaggacggacgaggtctagacttagttactgtacaaacngtaacgacagtagagtactntagttgggtcgttcggcggaggaccgagcgtacggccgtcgtaggctacggaccaaggcctcgccccgtcgg

SEQ ID NO: 200799 - DNA, 550 bp, Homo sapiens
  misc_feature: GYAE6OF01DUR5A.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagatccctgagcgtattctctggctccagctcgagggcagcagtcacgttgactatcagtgaacgtccaggacaggaggacgaggctagactattacgtgtacaacgagtagacgaagtagaggttactacgtagttgggttcggttcgggacgggtagggaccgaagtcgtacggtacccgtacgtacggtaccgacggacccgaaggtccgtcccggtcccccgttacccggg

SEQ ID NO: 200800 - DNA, 526 bp, Homo sapiens
  misc_feature: GYAE6OF01DV86N.21.46.E02.1.454.CMB.1.raw
  modified_base (314)..(314): a, c, t, g, unknown or other
  misc_feature (314)..(314): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgccaaaagaaatatgcttattggtaccaacagaagccaggccaggccccctgtgttagtgatatataaaagacactgagaggccctnagagatccctgagcgattctctggctccagctcagggacaggcagtcacgttgactatcagtgaagtcccaggcaagaggacgaggctgacttattactgtacaaanagtaagacgagtagaggtactcgtagttgggtgttcgggcgggaagggaccgaaaggcgtggacccgtccgtaggtcgacgacccaaggcctcgcccccgttcgg

SEQ ID NO: 200801 - DNA, 579 bp, Homo sapiens
  misc_feature: GYAE6OF01DKD6Y.21.46.E02.1.454.CMB.1.raw
  modified_base (243)..(243): a, c, t, g, unknown or other
  misc_feature (243)..(243): n is a, c, g, or t
  modified_base (386)..(386): a, c, t, g, unknown or other
  misc_feature (386)..(386): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatntgtacttattaggtaaccaacaagaacgccgaggccaggcccctgtgttagtgataataataaagacactgagacggcctagagagactcccgtgacgcgtattctcgtggcctccagctacgagggacagacagtcacgttnactatacagtgaacgtcgaggacgaggaggacgaggctagtacttaattacgtagtacaaacagtagaacgaggtagaggttactcgtaggttgggtgttacgggcgggtaaggaccgtaaggccgtacggtacccgttaccgtaacgggtacctaccggacccgaagggtccctcccggcccccgttaccgg

SEQ ID NO: 200802 - DNA, 562 bp, Homo sapiens
  misc_feature: GYAE6OF01DL8JM.21.46.E02.1.454.CMB.1.raw
  modified_base (241)..(241): a, c, t, g, unknown or other
  misc_feature (241)..(241): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatntgcttattggtaccaacagaagccaggccaggcccctgtgttagtgatataataaagacactgagaggccctcagagactcccngagcgtattccgtctggctccagtctcgagggacagcagtcacgttgactatcagtagaacgtaccgaggcgaaggacggaacgaggctagacttatttacgagtaacaaacgagtaagaacgtagtagtagtacttcgagttgggtagttcgggcggtaagggaccgaaggtgtacggtacccgtcgtaagggccgaacgtacccgaaagggtcctacccggcccccgttaccggg

SEQ ID NO: 200803 - DNA, 421 bp, Homo sapiens
  misc_feature: GYAE6OF01B68T5.21.46.E02.1.454.CMB.1.raw
  modified_base (407)..(407): a, c, t, g, unknown or other
  misc_feature (407)..(407): n is a, c, g, or t
  modified_base (412)..(421): a, c, t, g, unknown or other
  misc_feature (412)..(421): n is a, c, g, or t
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattcctggggccagggaccctggtaaccgtctcctcagcctccaccaagggcccatcggtcttccccctggcgccctgctccaggagcacctccgagagcacagcggccctgggctgcctggtcaaggctacttcccgagcgacgactgagcgggctgggcaaggcgnatagnnnnnnnnnn

SEQ ID NO: 200804 - DNA, 637 bp, Homo sapiens
  misc_feature: GYAE6OF01B5NI4.21.46.E02.1.454.CMB.1.raw
  modified_base (242)..(242): a, c, t, g, unknown or other
  misc_feature (242)..(242): n is a, c, g, or t
  modified_base (304)..(304): a, c, t, g, unknown or other
  misc_feature (304)..(304): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtctcagtgtccccgggacaaacggccaggatcacctgctctggagatgcattgaccaaaaaatttnttgtttttaggaccagcagaagtcaggccaggcccctgtgttggtcatccatgaggacaggngacgacccgtcggatcccgtgagagattctcgtcggctaccaactcgagggtacggtcggcctacgttgattctacgaggtcggggacccagggttacggagggataggaagtcgtagaacttactacgttgttacttcgagcagacagcagtgctagtcgaggggctaggttcggacgggacggaccgtagggttaccggaccgtaccggtacggttaccgacggtaccccgaaagggtccctcccgggtacccccccgttaccgggttacccgtaacccgttcccgttacccgtttacccccctaccccccgttcccccgtttacccccgg

SEQ ID NO: 200805 - DNA, 540 bp, Homo sapiens
  misc_feature: GYAE6OF01C4RYR.21.46.E02.1.454.CMB.1.raw
  modified_base (241)..(241): a, c, t, g, unknown or other
  misc_feature (241)..(241): n is a, c, g, or t
  modified_base (467)..(467): a, c, t, g, unknown or other
  misc_feature (467)..(467): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctggtgtcagtcgtccccaggacagacggccaggatcacctgctctgcagatggactgaccaaaagaatntgcttattggtaaccaacagaagccaggccaggcccctgtgttagtgatataataaagacactgagaggccctacagagactccctgagcgattctcgtggctccagctcgagggacagcagtcacgttgactatcgagtagaagtccaggcaggacggagaggctagacttattacgtgtacaaacagtaagacagtaagaggttactatagttgggtgttcggngggagggaccgaagtcgtacggtcccgtaccgtaggtccacggacccgaaggcccgtcgcccccgttaccggg

SEQ ID NO: 200806 - DNA, 625 bp, Homo sapiens
  misc_feature: GYAE6OF01DIL9E.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctgcagatggactgaccaaagaatatgcttatggtaaccaacagaagcaggccacggcccctgtcgttagtgatataataaagacactgagacggaccctgagagtactccgtagagcgatttctcgtcggcctccagcgtcaggggtacagcagtctacgttgactagtcgagtagtaacgtccgaagggcgaaggaaggaccggaggtacgtacgtaacttagttaacttcgtaaccaaaacgtaggtaaacgacgtaaggtaacgaacgggtacttacgtaaggtttcggggttaggttaccgggacggggtaagggaacccgtaaacggtcggtaccggtacccggttacgtaacggttacgaccggacccgaaaggtcccgttacccggccccccgtttaccggg

SEQ ID NO: 200807 - DNA, 547 bp, Homo sapiens
  misc_feature: GYAE6OF01ATJVK.21.46.E02.1.454.CMB.1.raw
  modified_base (262)..(262): a, c, t, g, unknown or other
  misc_feature (262)..(262): n is a, c, g, or t
  modified_base (318)..(318): a, c, t, g, unknown or other
  misc_feature (318)..(318): n is a, c, g, or t
  modified_base (433)..(433): a, c, t, g, unknown or other
  misc_feature (433)..(433): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaatatgacttattaggtaccaaanagaagccaggccaggcccctgtgttagtgatataataagacactgagacggccctnagagatcccgtgagcgattctcgtgcctcagctacgagggacagcagtcacgttgactatcagtgaagtcaggcaggaggacgaggctagacttatactagtacaaataggtaanagaagtagagttactacgtagttggggtgtacgggcgggtaggaaccgaggtcgtacggtacccggttacgtaggccgaacgacccggaagtcccgtccggcccccgttacggg

SEQ ID NO: 200808 - DNA, 539 bp, Homo sapiens
  misc_feature: GYAE6OF01CIZWM.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaagacactgagacgcctanagagactccctgagcgattctctggctccagctcgagggacagcagtcacgttgactatcgagtagaacgtcaggcaaggaggacgaggctgactattactacgtacaacagtagacgagtagagtactcgtagttgggtggttcggacgggacggaaccgacgtacgtcggacccgttaccgtaggtaccgacggacccgacggccgtccgcccccgttaccgg

SEQ ID NO: 200809 - DNA, 575 bp, Homo sapiens
  misc_feature: GYAE6OF01A5JQP.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgccaaaagaatatgcttattggaaccaacagaagccaggccaggcccctgtgttagtgataatataaaagacatgagacggccctnagagactcccgtagagcgtattctcgtggccttaccagctacgaggggacagcaagtccagttcgacttatcgagtacgaagtcccgaggcaggacggacgagcgtagaactattacgtagtacaaacagtaacgacgtaagtaggagttactcgtaagttgggtagttcgggacgggtacgggaaccgtaaggcgtacggacccggttactagggttacgaccggtacccgaagggtcccgtccggtcccccgtaccggg

SEQ ID NO: 200810 - DNA, 612 bp, Homo sapiens
  misc_feature: GYAE6OF01E415A.21.46.E02.1.454.CMB.1.raw
  modified_base (315)..(315): a, c, t, g, unknown or other
  misc_feature (315)..(315): n is a, c, g, or t
  modified_base (382)..(382): a, c, t, g, unknown or other
  misc_feature (382)..(382): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaatatgtcttataggtaccaacagaagccaggccaggcccctgtgttatgatatataaagacactgagacggccctnaagacgactccctaggacgcgtacttctcgtggcctccagctacgaagggacagcacgtcacgttanactatacgagtagaacgtcgaaggtacaggaagggacgaggtacctagtaaccttaagttacgtacgtaactaaacgtaggtaacgacgtaagggtaagtaacggttaccttagtaggttgggttggttaccgggacgggaacgggaaccctaaggcgttaaccggcccgttaccggtacggtaccggaaccgacccgaaggcccgttaccccggccccgtttaacccgg

SEQ ID NO: 200811 - DNA, 584 bp, Homo sapiens
  misc_feature: GYAE6OF01DRAH5.21.46.E02.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtacaacagaagccaggccaggcccctgtgttagtgatatataaagacactgagaggccctnagagatccctgagcgattctctggcctccagctcgagggacagcagtcacgttgactatcaagtgaagtccgaggacagaggacggaggctagacttattactagtacaaacagtaagaactaagtagaggtactacgtagtttgggtacggttcgggcgggtaacgggaaccgtaaacggtccgttacggtaaccccggttacccgttagggtacccgtaacgggacccccgaaaggggtccccgttcccggtcccccccggttacccgggg

SEQ ID NO: 200812 - DNA, 556 bp, Homo sapiens
  misc_feature: GYAE6OF01A5BAR.21.46.E02.1.454.CMB.1.raw
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctanagagactccctgancgattctctggctcagctcgaggacagcagtcacgttgactatcagtgaagtccaggcaggaggacgaggctagactattacgtgtaacaacgagtaagacgtaaggtaagaggttactacgtagtttggggttacggttcgggacgggtaacgggaaccaacggtcttacgggtacccgtcgtaacgggtaccgacggacccgaagggtcctccggcccccgttcggg

SEQ ID NO: 200813 - DNA, 574 bp, Homo sapiens
  misc_feature: GYAE6OF01EKDN3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtacttattcggtaaccaacagaacgccaggccacggccctgtgttagtgatataataaagacacgtagagacggccctgaagagactcccgtagacgcgtattctcgtggctcagctcgagggacagcagtcacgttgactatcgagtagaacgtccgaggcaaggacggacgaggtctagtaacttagttactagtaacaaagtagtaagaacgtaggtaagaagttactagtaggtttgggtaggttaccgggagggaacgggtaccgtaaggtcgtacggtacccgtacgtaggtaccgacgacccgaaggcctccgccccgtacgg

SEQ ID NO: 200814 - DNA, 501 bp, Homo sapiens
  misc_feature: GYAE6OF01EIJ38.21.46.E02.1.454.CMB.1.raw
  modified_base (315)..(315): a, c, t, g, unknown or other
  misc_feature (315)..(315): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (433)..(433): a, c, t, g, unknown or other
  misc_feature (433)..(433): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatccacctgctctgcagatggactgaccaaagaaatatgcttattggtaccaacagaagccaggccaggcccctgtgttagtgatatataaagacactgagacggccctnagagactccctgagcgattctctggctccagctcgagggacagcagtcacgttnactatcagtgagtcaggcagagcgagntgactatactgacaanagtanacgagtagagtactanagttgggtgtcggcggaggaccgaagtcgtaggccgtacgtaggtcacgcccaggcctcgccccgtcg

SEQ ID NO: 200815 - DNA, 517 bp, Homo sapiens
  misc_feature: GYAE6OF01B35IJ.21.46.E02.1.454.CMB.1.raw
  modified_base (241)..(241): a, c, t, g, unknown or other
  misc_feature (241)..(241): n is a, c, g, or t
  modified_base (334)..(334): a, c, t, g, unknown or other
  misc_feature (334)..(334): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgctttattggtaccaacagaagccaggccaggcccctgtgttagtgatatataaagacactgagaggccctcagagatccctgagcgattcnctggctccagctcgagggacagcagtcacgttgactatcagtagaagtcgagcagagacgagctagactattacngtacaactagtanagagtagaggttactcgtagttggtgttcggaggacggaaccgaggctacggaccgtccgtaggcgtacgaccgaacggctcgcccccgttacgg

SEQ ID NO: 200816 - DNA, 557 bp, Homo sapiens
  misc_feature: GYAE6OF01EAJPF.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagactccctgagcgattctctggctcagctcgagggacagcagtcacgttgactatcagtgaagtccgagcagacggagaggctgactattactagtacaaactagtaagaacgtaaggtagtaggttactacgtagtttggggtagttcgggacgggaagggtacccgaaggtcctacggtacccgttacgtacggtaccgtacggaccccgaaggtccgtcccggcccccgttacccggg

SEQ ID NO: 200817 - DNA, 571 bp, Homo sapiens
  misc_feature: GYAE6OF01ELNGX.21.46.E02.1.454.CMB.1.raw
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgcttattggtaccaacagaagccaggccacggcccctgtgttagtgatataataaagacactgagacggccctnaagagactcccgtgacgcgtattctcgtcggctccagcctcgagggacagcagtctacgttagactagtcagtagaacgtccgaggacaggacggacgaggtctagacttacttacgtacgtaacgaaacgtaacgtaagaacgaggtaagaggttaactgtagtttggggtgttacgggacgggtaacggacgaacgtcgtacggacccgtacgtaggccacgacccgaaggcctccggtcccccgttaccgg

SEQ ID NO: 200818 - DNA, 566 bp, Homo sapiens
  misc_feature: GYAE6OF01D2IF8.21.46.E02.1.454.CMB.1.raw
  modified_base (241)..(241): a, c, t, g, unknown or other
  misc_feature (241)..(241): n is a, c, g, or t
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaaccaacagaacgccaggccaggcccctgtgttagtgatataataaagacactgagacggccctcagagactccctgagcgtattctctggcctccagctcgagggacagcagtcacgttgaacttatcgtaagtagtaacgtccgaggacaaggaggacgaggctgacttattactgtaacaaanagtagaacgtaagtaggagttactacgtaggttgggtggttacggcgggtaagggaaccgtaaggcctaggtacccggtaccgttagggtaccgacggtacccgaaggcccgtccgcccccgttacgg

SEQ ID NO: 200819 - DNA, 499 bp, Homo sapiens
  misc_feature: GYAE6OF01D27GG.21.46.E02.1.454.CMB.1.raw
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggccccctgtgttagtgatatataaagacactgagaggccctcagagatccctgagcgattctctggctcagctcagggacagcagtcacgttgactatcagtgaagtccaggcagaggacgaggctgactattactgtcaaacngtagacagtagaggtactcattgggtgttcggcggagggaccgaagctggccgtcgtaggtcacgcccaaggcctgcccctcgg

SEQ ID NO: 200820 - DNA, 612 bp, Homo sapiens
  misc_feature: GYAE6OF01CDVH7.21.46.E02.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctgcagatggactgaccaaaagaaatatgcttattaggaaccaacagaagccaggccaggccctgtgttagtgatataataaagacactgaagacggccctanagagactcccgtgacgcgtattctcgtcggctccagtctacgagggacagcagtctacgttgactatcagtagaagtccgaggcgaaggaggacgaggctagacttactacgtagtaaccaaacgaagtaacgacgaagtaacggtaacgtacttacgtagtttcggggttagggttaccggggacgggtaaacgggaacccgtaaggaccgttacggtaccccggttaccgtaacgggttaccgtaacggaccccgaaagggtccctacccgggtccccccgttaccggg

SEQ ID NO: 200821 - DNA, 573 bp, Homo sapiens
  misc_feature: GYAE6OF01BGDD1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatatgcttattggtaaccaacagaagccaggccaggcccctgtgttagtgatataataaagacactgagacggccctagagagactcccgtagacgcgtattctctggctccagctcgagggacagcagtctagttgaactatcgagtacgaacgtcgaggacaaggacggacgaggtacgtagtaacttattacgtagtaaccaaacgagtaacgacgtagtagagttactacgtagttgggtggttacgggacggacgggtaacctaggtcgtacggtacccgtacgtacggtaccgacggaccccgaaggtccgtcccggcccccgttacggg

SEQ ID NO: 200822 - DNA, 576 bp, Homo sapiens
  misc_feature: GYAE6OF01EN642.21.46.E02.1.454.CMB.1.raw
  modified_base (323)..(323): a, c, t, g, unknown or other
  misc_feature (323)..(323): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgtactttattacggtaaccaacagaacgccaggccacggcccctgtgttagtgatataataaagacatagagacggccctnagagactcccgtgacgcgtattctcgtgcctcagctcgagggacagcagtcgtacgttgactatcagtagaagtcgagcaggaggacgagctgacttattacgtgtacaaacgtagtaagacgtaggtagtacggttactagtagttgggtcggttacgggacgggaagggtaacccgaggtcgtacggtacccggttaccgttaggtaccgtacggaccccgaagggtccctcccggccccccgttaccggg

SEQ ID NO: 200823 - DNA, 505 bp, Homo sapiens
  misc_feature: GYAE6OF01A6TV8.21.46.E02.1.454.CMB.1.raw
  modified_base (313)..(313): a, c, t, g, unknown or other
  misc_feature (313)..(313): n is a, c, g, or t
  modified_base (415)..(415): a, c, t, g, unknown or other
  misc_feature (415)..(415): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaaggccaggcccctgtgttagtgatatataaagacactgagaggccctnagagatccctgagcgattctctggctccagctcagggacagcagtcacgttgactatcagtgaagtcaggcagaggacgaggctgactattactgtacaaanagtagacagtagaggttactcgattgggtgttcggnggaggacgaagcgtgaccgtccgtaggtcacgacccaaggctcgccccgtacgg

SEQ ID NO: 200824 - DNA, 518 bp, Homo sapiens
  misc_feature: GYAE6OF01CIX92.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatccacctgctctgcagatggactgaccaaaagaatntgcttattggtaccaacagaagccaggccaggcccctgtgttagtgatatataagacactgagaggccctgagagatcccctagacgcgtattctctggctccagctcgagggacagcagtcacgttgactatcagtgaagtcagcagaggagagtctagactagtactgtacaaacagtagacaagtagaggttactcgagttgggtgttcggcgggaggaccgagcgtacggccgttaccgtaggtcacgcccgaaggcctcggcccccgtacgg

SEQ ID NO: 200825 - DNA, 247 bp, Homo sapiens
  misc_feature: GYAE6OF01B20JW.21.46.E02.1.454.CMB.1.raw
  modified_base (244)..(247): a, c, t, g, unknown or other
  misc_feature (244)..(247): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttccctcgtctctactgagcgggctggcaaggcgcatagnnnn

SEQ ID NO: 200826 - DNA, 501 bp, Homo sapiens
  misc_feature: GYAE6OF01E27G5.21.46.E02.1.454.CMB.1.raw
  modified_base (311)..(311): a, c, t, g, unknown or other
  misc_feature (311)..(311): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctgcagatggactgccaaagaaatatgcttatggtaccaacagaagccaggccaggcccctgtgttagtgatatataaagacactgagaggccctnagagatcccctgagcgattctctggctccagctcagggacagcagtcacgttgactatcagtgaagtccaggcagaggacgaggctgactattactgtacaaacngtaagacagtagagtactnagttgggtgttcggcggaggaccgaagctgacccgtctaggtcagcccaaggcctgcccccgtcgg

SEQ ID NO: 200827 - DNA, 524 bp, Homo sapiens
  misc_feature: GYAE6OF01D4R1J.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgacttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacagtaagacagtagaaggtactactagttgggtgttcggcggagggaccgaaaggtcgtagtacccgtcgttaggccacgacccgaaaggcctcgcccccgtacgg

SEQ ID NO: 200828 - DNA, 647 bp, Homo sapiens
  misc_feature: GYAE6OF01BM4XN.21.46.E02.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgcttattggtaaccaacagaagccaggccaggcccctgtgttagtgatatataaagacactgagacggccctanagagactcccgtagagcgtattctctggcctccagctgagggacagcagtctacgttgactatcgagtgaagtcccaggcgagaggaacgaggtacgtcgtaacttaattacgtacgtaacaaacgtacggtaaagaaccgaaggtaacggtaaggttaacctacggtagtttcgggggttacgggtttcgggacggggtaaacggggaacccgtaaacgggtaccggttacggtaaccccgggtttaccgtaaacggggttacccgtaacgggtaaccccccgtaaacggggtcccgttaccccgggtccccccccggttaacccggg

SEQ ID NO: 200829 - DNA, 576 bp, Homo sapiens
  misc_feature: GYAE6OF01D53BT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgacttattaggtaaccaacagaagccaggccacggcccctgtgttagtgatataataaagacactgagacggccctagagagactcccgtgacgcgtattctacgtcggctccacgcgtacgagggacacgcgagtctacgttgaactatacagttgaacgtccgaggacgaggacggacgagctagtactattacgtagtacaaagagtaagacgtaaggtagtaaggttactacgagttcggggtagttcgggacgggaaggtaccgaaggtctacggtaccgtacgtacggtcgaccgacccgtaaggcctcccggtccccgtacccgg

SEQ ID NO: 200830 - DNA, 527 bp, Homo sapiens
  misc_feature: GYAE6OF01CKLK0.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatntgcttattggtaccaacagaagccaggccaggcccctgtgttagtgatataataaagacactgagaggccctcagagatccctagagcgattctctaggctccagctcgagggacagcagtcacgttgactatcagtgaacgtcaggcaggaggacgaggctgacttattactgtacaaacagtagacagtagagtactagagttgggtgttcggcggagggaccgaagtctcggaccgttaccgtaggcgtacgacccgaaggcctccggcccccgttaccgg

SEQ ID NO: 200831 - DNA, 546 bp, Homo sapiens
  misc_feature: GYAE6OF01CZIW7.21.46.E02.1.454.CMB.1.raw
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgataataataaagacactagagaggcccctanagagatcccctgagcgattctctggctccagctcgagggcagcagtcacgttgaactatcgagtgaagtccaggacaaggaggacgaggctagactattactagtacaaacgagtaagaaagtagaggtactcgtagttgggtggttacgggcggagggaccgaaggtcgtaggacccgttcgtacggtcacggtcccgaagggcctcccggtcccccgtcggtaccc

SEQ ID NO: 200832 - DNA, 542 bp, Homo sapiens
  misc_feature: GYAE6OF01D21DU.21.46.E02.1.454.CMB.1.raw
  modified_base (316)..(316): a, c, t, g, unknown or other
  misc_feature (316)..(316): n is a, c, g, or t
  modified_base (363)..(363): a, c, t, g, unknown or other
  misc_feature (363)..(363): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgctttattggtaaccaacagaagccaggccaggcccctgtgttagtgatatataaagacactgagaggccctanagagatccccgtgacgcgtattctcgtggctccgagctcgagggacngcagtcacgttgactatcagtgaacgtccaggacaggacggacgaggctagacttattactgtacaaacgagtagacgtagtagtaggttactactagttggtggggggttcacgggagggaccaaggctcggaccgtccgtaggtacgacggacccaaggtcctccgcccccgtacgg

SEQ ID NO: 200833 - DNA, 249 bp, Homo sapiens
  misc_feature: GYAE6OF01DNTIG.21.46.E02.1.454.CMB.1.raw
  modified_base (244)..(249): a, c, t, g, unknown or other
  misc_feature (244)..(249): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttccctcgtctctactgagcgggctggcaaggcgcatagnnnnnn

SEQ ID NO: 200834 - DNA, 698 bp, Homo sapiens
  misc_feature: GYAE6OF01EER24.21.46.E02.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgtacttattggtaaccaaacagaagccaggccacggcccctgtgttagtgatataataaagacatgagacggccctanagagactcccgtgacgcgtattcctcgtcggtctccgagcctacgaacggggacacggacgtacgttccgaacggtttacgaacttaacgtacgaaggttaggaaaccggttaccgaagggacgaaaggggtaacgggaaccgggaagggtaccttacgggtaaactttaacgtttaaccgttacgtaaaccgtaaaacgtaggttaaacgaacgtaaacgggttaaggtaacggttaacttaccgttaaggtttcggggttacgggttaccgggacggggtaaacgggaacccgtaaaggtccggtacggtaccccggttacgtacgggtaccaaccggacccgaaacggtccgtacccggcccccgttaccggg

SEQ ID NO: 200835 - DNA, 645 bp, Homo sapiens
  misc_feature: GYAE6OF01BHTWV.21.46.E02.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaagaatatgcttattggtaccaacagaagccaggccaggcccctgtgtagtgatataataaagacactgagagccctnagagacttccagagcgtattctcgtggctccgagctacgagggacagcagtctacgttgaactatacagtgaacgtcaggacaggaggacgaggctagtaacttacgtacttaggtaaccaaacgtagttaacgaacgaggttaaacggaggttaactaccgttaggtttacgggttacggtttcccggggaacggggtaaacgggtaaacccgtaacgggttacccgttaacgggttacccccgggttaccgttaacgggtacccgtaaacccgggaccccggttaaaaccggggccccggtttacccggaaccccccccggtttacccgggg

SEQ ID NO: 200836 - DNA, 517 bp, Homo sapiens
  misc_feature: GYAE6OF01D8DFS.21.46.E02.1.454.CMB.1.raw
  modified_base (316)..(316): a, c, t, g, unknown or other
  misc_feature (316)..(316): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaaagacactgagacggccctnagagatccctgagcgattctctggcctccagctcgacgggacagcagtcacgttgactatcagtgaagtccaggcagaggacgaggctgactagttactgtacaaacngtagacagtagagtactacgagttgggtgttcgggcggaggaccgaagtctacggaccgtctaggtcacgacccgaaggctcgccccgtacgg

SEQ ID NO: 200837 - DNA, 556 bp, Homo sapiens
  misc_feature: GYAE6OF01B51MV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctccttcactctctgcacaggctctgaggcctcctatgagctgacacagccaccctcggtgtcagtcgtccccaggacagacggccaggatcacctgctctgcagatggactgaccaaagaatatgcttattggtaccaacgagaagccgaggccaggcccctgtagttagtgatatataagacacgtgagagccctacagagactccctgacgcgattactctggcctacagctcgagggacagcagtcctacgttgactagcagtagaacgtccgaggcaggaggacgaggcgtagaactagttactagtacaaacagtaacgacgaggtaagaggttactcgtagttcgggtcgttcgggcgggtagggaccgaacgcgtacggaccgttccgtacggtaccgacgaccccgaaggccgtccgcccccgttaccgg

SEQ ID NO: 200838 - DNA, 527 bp, Homo sapiens
  misc_feature: GYAE6OF01AWOZD.21.46.E02.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataagacactgagaggccctcagagactccngacgcgattctcgtggcctccagctcgagggacagcagtcacgttgactatcagtgaacgtcaggcaggaggacgaggctgactagtactgtacaacagtagacagtagacgtactgagttgggtgttcggacggacgggacaacggtgtacggtaccgtccgtaggtccgacggacccgaaggtccctccggtccccctccggg

SEQ ID NO: 200839 - DNA, 775 bp, Homo sapiens
  misc_feature: GYAE6OF01D3083.21.46.E02.1.454.CMB.1.raw
  modified_base (262)..(262): a, c, t, g, unknown or other
  misc_feature (262)..(262): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaaagaatatgtacttattaggtaaccaanagaagccaggccacggcccctgtgttagtgtaatataataaagacacgtagaagacgtccctagagagactcccgtagagtacgtattccgtacgtcggtcctccgagtccgttacggaacggggtaaccacggtaccgaacggtttcgtaaccggtttacggaacctttaacgttaccgtaaagggttaacgggtaaaccgttccccggaagggtaacccggtaaagggaacgggtaaccgggaacgggtaccttaagggtaaacctttaacggtttaaaccgttaggtaaaccgtaaaaacggtaggttaaacggaaaccgttaagggttaaacggaacggtttacttaacggtagggttttcgggggtacgggttaccggggtaaccggggaacgggtaaccccgtaagggtaccgttaccgggtaaccccggttaccggttaagggaccccgtaaccgggaccccggttaaagggtccccggttaccccgccccccggtttaacccggg

SEQ ID NO: 200840 - DNA, 504 bp, Homo sapiens
  misc_feature: GYAE6OF01D095O.21.46.E02.1.454.CMB.1.raw
  modified_base (323)..(323): a, c, t, g, unknown or other
  misc_feature (323)..(323): n is a, c, g, or t
  modified_base (452)..(452): a, c, t, g, unknown or other
  misc_feature (452)..(452): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatataataaagacactgagaggccctcagagatcccngagcgattctctggctccagctcagggacagcagtcacgttgactatcagtgaacgtcaggcagaggacgaggctgactattactgtacaaacagtagacaggtagaggtactcgagttgggtgtcggnggaggaccgaagctggaccgtcgtagtcacgacccaggcctcgccccgtcgg

SEQ ID NO: 200841 - DNA, 613 bp, Homo sapiens
  misc_feature: GYAE6OF01B69J2.21.46.E02.1.454.CMB.1.raw
  modified_base (303)..(303): a, c, t, g, unknown or other
  misc_feature (303)..(303): n is a, c, g, or t
  modified_base (330)..(330): a, c, t, g, unknown or other
  misc_feature (330)..(330): n is a, c, g, or t
tcagtcgtcgctcgcacgaccggtgctcgatttagactcatctacagggaaaggggtgggtccaggaggcaggaactctgggtgtctcaccatggcctggatccctctacttctccccctcctcactctctgcacaggctctgacggccctcctatgagccgtcgacacagcccaccctcggtgtcagtgtccccaggacagacggccaggatcgacctgactctgcagatcggactgaccaaaagaatactcgacttattggtaccaaactagaagccaaggccaggccccctggtgttagngatatataagacactgagacggccctnagagactcccctgacgcgtattccgcgtcgggcctcccgagctcgagggacagcagtctacgttgactagtactaggtagaacgtccgagacgagtaggacgagctgacttagttacgtcgtacaaacgtgtaacgacgtaagtagacggttaacctcgtaacgtttcggggtcgttaccgggccgggtaacgggaccctaaggtacccgttaccggacccgtttcccgtaacgggtctaaccggtaccccgaagggtccctccggtccccccggttaccggg

SEQ ID NO: 200842 - DNA, 702 bp, Homo sapiens
  misc_feature: GYAE6OF01A6MNI.21.46.E02.1.454.CMB.1.raw
  modified_base (296)..(296): a, c, t, g, unknown or other
  misc_feature (296)..(296): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgtacttagttaggtaaccaactagaacgccaggccacggcccctgtgttagngatataataaagacagtgagacggccctagagagtactcccgtgacgtcgtattccgtcgtggtcctccgagtccgtacgaggggaaccacggaccgacgtccgtaacgtttcggaaccttacgtctacggttagaacgttccgaacggacgtaacgggacgggaacggtaggtcgtagtaaccgttagttaacgtacgtaacaaacgtagtaaggaacgtaaggtaacggtaacggttacgttacggtaaggtttcgggttacgggttacggggtaccggggtaaaccggggtaaccgtaacgggttacccggtaccgggtaacccggttacccggttaggtacccgtaaccgggtaccccggtaacggtccccggttacccggtacccccccgtttacccgggg

SEQ ID NO: 200843 - DNA, 503 bp, Homo sapiens
  misc_feature: GYAE6OF01EM4WR.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatcccctgagcgattctctggctcagctcagggcagcagtcacgttgactatcagtgaagtcaggcagaggacgaggctgactattactgtacaacgagtagaacagtagagtactcagttgggtgttcggcgggagggaccaggctggacccgtcgtaggtcacgcccaaggctcgcccccgtcgg

SEQ ID NO: 200844 - DNA, 509 bp, Homo sapiens
  misc_feature: GYAE6OF01B2XZQ.21.46.E02.1.454.CMB.1.raw
  modified_base (415)..(415): a, c, t, g, unknown or other
  misc_feature (415)..(415): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcgagggacagcagtcacgttgactatcagtgaacgtcgaggcagaggacgaggctgactatactgtacaanagtaganagtagaggtactnagttggtggttcggacggtagggacctagctcggaccgtcctaggtcacgacccaaggcctcgcccccgtacgg

SEQ ID NO: 200845 - DNA, 599 bp, Homo sapiens
  misc_feature: GYAE6OF01EHCCI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtgtccccaggacagacggccaggatcacctgctctgcagatggactgaccaaagaatatgcttattggtaccaacagaagccaggccaggcccctgtgttagtgatatataaagacatgagacggccctcagagactccctgacgcgattctcgtggcctccgagtctcgagggacagcgacgtactacgttagaacttagtacgagtagaacgtccgaaggacgaggacggacggaggtctacgtacttattacgtacgtaccaaacgtagtaagacgtaaggtaacggtaacggttacttacgtaggttgggttacggttcgggacggggaacgggaccgtaacggtcgtacggacccgttccgtacggtaccgaccgtacccgaaggtcccgtcccggcccccgttaccggg

SEQ ID NO: 200846 - DNA, 256 bp, Homo sapiens
  misc_feature: GYAE6OF01BUFRO.21.46.E02.1.454.CMB.1.raw
  modified_base (244)..(256): a, c, t, g, unknown or other
  misc_feature (244)..(256): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacgactgagcgggctggcaaggcgcatagnnnnnnnnnnnnn

SEQ ID NO: 200847 - DNA, 700 bp, Homo sapiens
  misc_feature: GYAE6OF01BSAII.21.46.E02.1.454.CMB.1.raw
  modified_base (240)..(240): a, c, t, g, unknown or other
  misc_feature (240)..(240): n is a, c, g, or t
  modified_base (347)..(347): a, c, t, g, unknown or other
  misc_feature (347)..(347): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatntgtcttattggtaaccaacgagaacgccgacggccgacggtcccctggttagttagtgtaatataagtaaacgactagtagaagtacggccctagagagtactccgngagctattctcgtggctcgacgctacgacgggacacgcgtaacgtcgtacggttacgacttagtctaaggtacggtaacctcggaaggacgaaagggacggtaacgacggtactacggtacttaacgttactaacggtaactaaacgaagttacgaacggtaagttaggtaaacggttacctaggttacgggtttacggggtagggttaccggggaaccggggtaaccgggtaaaccgtaacgggtacccgtttacggggaaaccccggtttacccgggttaaggggaccccgtaaccgggaccccggttaaacggtcccggttacccccgggtcccccggtttaaccccggg

SEQ ID NO: 200848 - DNA, 532 bp, Homo sapiens
  misc_feature: GYAE6OF01CLJQ7.21.46.E02.1.454.CMB.1.raw
  modified_base (314)..(314): a, c, t, g, unknown or other
  misc_feature (314)..(314): n is a, c, g, or t
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggccccctgtgtagtgatatataaagacactgagaggccctnaganatccctgagcgattctcgtggctccagctcgagggacagcagtcacgttgacttatcagtagaacgtccgaaggcaaggaggacgaggctaggacttagttactggtacaaacgagtagacgtagtagaggtactacgagttgggtgttcggacgggagggacctaaggctaggacccgttactaggcacgacccgaggctccgccccgtccgg

SEQ ID NO: 200849 - DNA, 499 bp, Homo sapiens
  misc_feature: GYAE6OF01AGW5N.21.46.E02.1.454.CMB.1.raw
  modified_base (311)..(311): a, c, t, g, unknown or other
  misc_feature (311)..(311): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagagccctnagagatccctgagcgattctctggctccagctcgagggacagcagtcacgttgactatcagtgaagtcaggcagaggacgaggctgactattactgtacaagagtagacagtagagtactnagttgggtnttcgggcggaggaccgaggctacggccgtctaggcacgccgaaggctcgccccgtcgg

SEQ ID NO: 200850 - DNA, 541 bp, Homo sapiens
  misc_feature: GYAE6OF01D9ZMG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatccctgagcgattctctggctccagctcagggacagcagtcacgttgactatcagtgaaagtccagcagaggacgaggctgactattactgtacaacaagtagacagtagaggtactacagttgggtgtttacgggcgggtaaggggacccgaaagccgtggtacccggtaccttagggtaccgtacggaccccgaaagggccttcggccccccgttaccggg

SEQ ID NO: 200851 - DNA, 508 bp, Homo sapiens
  misc_feature: GYAE6OF01ECX1N.21.46.E02.1.454.CMB.1.raw
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
  modified_base (374)..(374): a, c, t, g, unknown or other
  misc_feature (374)..(374): n is a, c, g, or t
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaaagaaatntgcttattggtaccaacagaagccaggccaggcccctgtgttagtgatatataaagacactgagaggccctnagagatccctgagcgattctctggctcagctcagggacagcagtcacgttgactatcagtnaagtccaggcagaggacgaggctgactattactgtacaaanagtaagacagtagagtactcgagttgggtgttcggcggaggacgaggctaggcccgtcgtaggtcacgacccgaaggtctccgcccccgtcgg

SEQ ID NO: 200852 - DNA, 246 bp, Homo sapiens
  misc_feature: GYAE6OF01BNVMI.21.46.E02.1.454.CMB.1.raw
  modified_base (244)..(246): a, c, t, g, unknown or other
  misc_feature (244)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttccctcgtctctactgagcgggctggcaaggcgcatagnnn

SEQ ID NO: 200853 - DNA, 516 bp, Homo sapiens
  misc_feature: GYAE6OF01APUJ7.21.46.E02.1.454.CMB.1.raw
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (421)..(421): a, c, t, g, unknown or other
  misc_feature (421)..(421): n is a, c, g, or t
  modified_base (467)..(467): a, c, t, g, unknown or other
  misc_feature (467)..(467): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctnagagactcccngagcgacttctcgtggctccgagcctcgagggacagcagtcacgttagactatcgtagtagagtccaggcaggaggacggagcgtagacttattacgtntacaaagtgtaagacgagtagagttactgtagttgggtgttacggnggacggacgagctaggaccgtcgtagcacgaccaggcctcgccccgtcg

SEQ ID NO: 200854 - DNA, 503 bp, Homo sapiens
  misc_feature: GYAE6OF01D19M0.21.46.E02.1.454.CMB.1.raw
  modified_base (469)..(469): a, c, t, g, unknown or other
  misc_feature (469)..(469): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagactccctgagcgtattctctggctccagctcgagggacagcagtcacgttgactatcagtgaagtcgaggcaggaggacgaggctagactattactagtacaaacgagtagacaagtagagtactgagttgggtgtcggcggagggacaagntgaccgtcgtagcacgaccaggctcgcccctcgg

SEQ ID NO: 200855 - DNA, 515 bp, Homo sapiens
  misc_feature: GYAE6OF01E4PE6.21.46.E02.1.454.CMB.1.raw
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (473)..(473): a, c, t, g, unknown or other
  misc_feature (473)..(473): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttatggtaccaacagaagccaggccaggcccctgtgttagtgatatataaaagacactgagacggccctcagagactccctgagcgattctctggcctccagctcaggggacagcagtcacgttgactatcagtgaagtccaggcagaggacgagctgactattactntacaaangtaanacgagtaagaggtactcgagttgggtggttcggcggaagggaccaagcgnggcccgtcgtaggtcacgacccaaggcctccgcccccgtcgg

SEQ ID NO: 200856 - DNA, 613 bp, Homo sapiens
  misc_feature: GYAE6OF01DBYU3.21.46.E02.1.454.CMB.1.raw
  modified_base (338)..(338): a, c, t, g, unknown or other
  misc_feature (338)..(338): n is a, c, g, or t
  modified_base (397)..(397): a, c, t, g, unknown or other
  misc_feature (397)..(397): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcgggtgtcagtcgtccccaggacagaccggccaggatcacctgctctgcagatggactgaccaaaagaatatgactttaattgggtaacccaacaagaaacgccgaggcccaggaccccccttgtggttagtgaatataataaagacaactgagacggccctnaagagatccctagagcgtaattctcgtggcctccgagctcgaggacagcagtcacgttnactatcgagtgaagtccaggacaaggaggaacgaggtcgtagtaacttaagttactagtacaaacgtagtaacgacgtaagtacggaagttactagtaggttgggtacgttaccgggcggggaacggtaaccgacgtacgtaccggtaccggttaccggtacggttaccgaccggtaaccccggaggtcccgtcccggtccccccgttaacccggg

SEQ ID NO: 200857 - DNA, 719 bp, Homo sapiens
  misc_feature: GYAE6OF01DREYO.21.46.E02.1.454.CMB.1.raw
  modified_base (243)..(243): a, c, t, g, unknown or other
  misc_feature (243)..(243): n is a, c, g, or t
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacagccaccctcggtgtcagtcgtccccaggacagacggccaggatcacctgctctgcagatggactgaccaaaagaatntgcttattacggtaccaacagaagccaggccacggccctgtgttagtgatataataagacactgagacgccctnagacgtactcccgtagacgacgtattcctacgtcggtcctccgacgtcctacgacgggacagactacgtactacgttagaactagtactaggtagaacgtcgaagggtacgaaggacggaacggaggtaccgttaggtaactttaacgtttaacgtacgtaacctaaaacgtaggttaaacgaaccggtaaggttaacgggtaacggttaaccgttacggttaagggtttcgggggtttaccggttaccgggggtaaccggggtaaacggggtaacccgtaaacgggttacccggtaacgggttaccccgggttacccgggtttaacgggtacccgtaaacccgggtaccccggtaaaaccgggtccccggttaacccggtcccccccggtttaacccgggg

SEQ ID NO: 200858 - DNA, 577 bp, Homo sapiens
  misc_feature: GYAE6OF01EFCDQ.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctgcagatggactgaccaaagaatatgcttattggtaaccaacagaacgccgaggccacgcccctgtgttagtgatatataaagacactagagacggccctanaagagactccctagacgcgtactttctcgtcggcctaccgagtcctacgagggacagcgagtcctacgttgacttatacgagtagaacgtcgaggacaaggaggacgaggtctagtacttattactacgtaacaaagtagtaacgacgagtagagtactacgtagttgggtgttaccgggacgggaacggaccgaagtccgtacggtacccgtacgtacgtacgaccgacccgaaggcccgttcccgcccccgtacgg

SEQ ID NO: 200859 - DNA, 796 bp, Homo sapiens
  misc_feature: GYAE6OF01C4259.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctcctatgagctgacacagcccaccctcggtgtcagtcgtccccaggacagacggccaggatccacctgctctgcagatggactgaccaaagaatatgacttattaggtaaccaacagaagccaggccagccctgtgtagtgatatataaagcagtgagacggcctagagagactccgtagacgcgtacttcgtcgtcggcctaccgagtccgtacgaaggggtaccacggtctacggtaccgtaacggtttacgaacgttagttaccggtaaggttacgaaacggttccccgaaaaaggggtccgaaaggggaacggggaaccgggtacgggtaccgttaacggtaaaccgtttaacgtttaacgtttacggtaaaccgaaaaccggtaaaggttaaccggaaacgttaaggggttaacggttaaccgggtttaaccgttacgggttaacgggtttttacggggggttaccgggtttacccgggggtaccgggggtaaaccggggtaaaccccgtaaaacggggttccccggtttaaccggggtaaacccccggtttacccggttaacggggttacccccgaaccggggttaccccccgtaaaccggggtcccccgtttaccccgggtccccccccggtttaacccgggg

SEQ ID NO: 200860 - DNA, 523 bp, Homo sapiens
  misc_feature: GYAE6OF01A19KC.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggcctccagctcgagggacagcagtcacgttgactatcagtgaagtccaggcaaggaggacgaggctagacttattactgtacaaacgtgtaagacagtagaggtactgagttgggtgttcgggcggagggtaccaaggcgtacggaccgtccgtaggtccacggacccgaaggcctcgcccccgtcgg

SEQ ID NO: 200861 - DNA, 581 bp, Homo sapiens
  misc_feature: GYAE6OF01CBHSS.21.46.E02.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagacggccctanagagactccctagacgcgtatttcctacgtggcctccgagtcctacgagggacagcagtcacgtttgactatacgagtagaacgtccaggacgaaggaggacgaggccgtagtacttacgttactagtaacaaagtagaagaacgtaggtaaggtaacggttacgtacgtagggtttgggttacggtcggggacgggaacggtacgacgtcgtacggtccgtccgtaggaccgaccgaccgaggtccctccggtccccgtaccgg

SEQ ID NO: 200862 - DNA, 543 bp, Homo sapiens
  misc_feature: GYAE6OF01AOAOW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagactccctgagcgattctctggctcagctcgagggacagcagtcacgttgactatcagtgaagtcccgaggcaggaggacgaggctgactattactgtacaaacgagtaagaacgtaggtagaggtactcgagtttgggtgttcgggcgggtacgggaaccgaaggtccgtacggacccgtccgtaggtaccgacggaccccgaagggcctccggccccccgttccggg

SEQ ID NO: 200863 - DNA, 724 bp, Homo sapiens
  misc_feature: GYAE6OF01C5ZRY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaagaatatgacttattcggtaaccaacagaagccaggccaggcccctgtgtagtgatataataaagacactgagacgccctcagagactcccgtagagcgtattctcgtacggctaccgagcctacgacgggacacgctagtacgacgttgaacttagtcgtaagtagaacgtacccgaaggaccgaaggtaacgggaccggagggtccttaggtaacctttaagtttaaccgtaggtaaccaaaacggtaagtaacgaaccgtaaggttaacggtaacggtttaaccttacgttaagggtttacgggggttaccggtttaaccgggggaccggggttaaaacggggaaacccgttaaacggggacccggtttaaccgggtaacccccgggtttaacccggttaaccggggttaacccgaacccggggtaaaccccccggtaaggggtaccccccgttaccccgggtcccccccccgggtttaacccgggg

SEQ ID NO: 200864 - DNA, 512 bp, Homo sapiens
  misc_feature: GYAE6OF01AGTYB.21.46.E02.1.454.CMB.1.raw
  modified_base (309)..(309): a, c, t, g, unknown or other
  misc_feature (309)..(309): n is a, c, g, or t
  modified_base (362)..(362): a, c, t, g, unknown or other
  misc_feature (362)..(362): n is a, c, g, or t
  modified_base (419)..(419): a, c, t, g, unknown or other
  misc_feature (419)..(419): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagcaggccaggcccctgtgttagtgatatataagacactgagagccctnagagactcctagagtcgattctctggctcagctcgaggacagcagtcacgttnactatcgagtgaacgtcgagcagaggacgaggctgactattactgtacaagagtaanacgtagtagacgtactagagttgggtgttcgggaggacggaccgagtcgtacgcccgtcgtaggtcacgcccgaaggctccggccccgtccgg

SEQ ID NO: 200865 - DNA, 508 bp, Homo sapiens
  misc_feature: GYAE6OF01B28V8.21.46.E02.1.454.CMB.1.raw
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggcgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtcaggcagaggacgaggctgactattactgtacaacngtagacagtagaggtactgagttgggtgttcggcggagggaccaagctggaccgtccgtaggtccacggcccaaaggcctcgccccctccggg

SEQ ID NO: 200866 - DNA, 723 bp, Homo sapiens
  misc_feature: GYAE6OF01BGVH0.21.46.E02.1.454.CMB.1.raw
tcagtcgtcgctcgcacgaccggtgctcgatttagactcatctacagggaaagggggtgggtccagggaggcgagaacctctgggtgtcgtcaccatggtcctggactcctctacttctccctcctcactctctgcacaggctctgaggtcctcctatgagtcgttcgactacacgtcctaaccgtcggtcgtcagtcgtcccgaggacagacggcgaggactcacgtgctcgtgcgacggactggactcgaccaaagaatagtcgtacttattcggtaaccaactacgaacgtccgaggccgaacggtccctgttacgttaggtcgtactaagtaacgtaaaacgacacgtacggaggacggccctagaggacgtactccgtagacgtacgacttcgtcgtcggtctaccacgtctacgaagggtacacggtacgacgtacgtacggttacgtacttactacgtaaggtacgtaaacgtaccgaacgggacgtaacggacgggtaacggtacggtacgtaacgtaacgttaacgttaaccgttacggtaaccgaaacgtacggtaacgaacgtaacggtaacggttaacggttaacttacgtaggttcggggtacggttacggggacgggtaacgggtaaccgaacggtacggtaccggtaaccggttaccgttaacggaccgtaacggtacccgtaaggtccgtccggtccccggtacggg

SEQ ID NO: 200867 - DNA, 508 bp, Homo sapiens
  misc_feature: GYAE6OF01D7ISF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctcagctcagggacagcagtcacgttgactatcagtgaagtccaggcagaggacgaggctgactattactgtacaaacagtagacagtagaggtactcagttgggtgttcggcggagggacccaaggctggacccgtccgtaggtccagccccgaaggcctcgcccccgtcgg

SEQ ID NO: 200868 - DNA, 552 bp, Homo sapiens
  misc_feature: GYAE6OF01C6TW2.21.46.E02.1.454.CMB.1.raw
  modified_base (318)..(318): a, c, t, g, unknown or other
  misc_feature (318)..(318): n is a, c, g, or t
  modified_base (376)..(376): a, c, t, g, unknown or other
  misc_feature (376)..(376): n is a, c, g, or t
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaacgccaggccaggcccctgtgttagtgatataataaagacactgagacggccctanagagactccccgtgagctatttctcgtggccttccagctcgaggacagcagtcagttnacttatcgagtgaacgtcgaggacaaggacggacgaggctagacttattacgcgtacaaacgngtaagaacagtagagtactcgtagttgggtagttcgggcggacgggacgaaggcctaggacccgttcgtacggtcaacggtacccgaaggtccctcggtccccccgtaccggg

SEQ ID NO: 200869 - DNA, 629 bp, Homo sapiens
  misc_feature: GYAE6OF01DMBME.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccaggacagacggccaggatcacctgctctgcagatggactgaccaaaagaaatatgcttattggtaccaacagaagccaggccacggcccctgtgttagtgatataataaagacactgagaggccctnagagatcctgagcgtattcctctggctccgagctcgaagggacagcagtcacggtttgacttaatcaaggtagaacgtcccgaagggcaggaggaacggtagggcctaggtacttaacgtttactacggtaactaaaacgagttaacgaacgtaagttaaggaaggttacttactaaggtttggggtgtttaccggggacgggtaaacggggaaccgtaaagggtcccgttacggtacccggttaccgttaaacgggttcccgaaacggtacccccgaaagggtcccgttcccgggcccccccgtttacccggg

SEQ ID NO: 200870 - DNA, 611 bp, Homo sapiens
  misc_feature: GYAE6OF01DT75D.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatntgctttatggtaccaacagaagccaggccaggcccctgtcgttagtgaatataataaagacactgagaggccctgagagactcccgtgagcgtattctcgtggcctccagtcctcgagggacagcagtctacgttgactatcagtagaacgtcgaggcaggacggacgaggtctacgacttaattactagtaacaaacgtagtaagactaaggtaagacggttactacgtaggttggggttacggttcgggacgggtaagggtaacccgtaagggtcccgttaacgggtaccccggttacccggttaagggtacccgaaccgggaccccgtaaacggggtcccgttcccgggtcccccccgttacccggg

SEQ ID NO: 200871 - DNA, 527 bp, Homo sapiens
  misc_feature: GYAE6OF01BWDMJ.21.46.E02.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctnagagactccctgacgcgattctcgtggctccagctcgagggacagcagtcacgttgactatcagtgaacgtccaaggcaggaggacgaggctgactattactgtacaaagagtaagacgagtagagtactcgtagttgggtgttcgggcgggtagggaccgaagtcgtacggcccgtcgtaggtcacggaccccgaaggccgtcgcccccgttcgg

SEQ ID NO: 200872 - DNA, 508 bp, Homo sapiens
  misc_feature: GYAE6OF01ASHF2.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcgagggacagcagtcacgttgactatcagtcgaagtccaggcaggaggacgaggctgactattactgtacaaatgaagacgagtagagtactcgtagttgggtgttcgggacggagggaccagctggaccgtctaggtacacgaccaaggcctgcccccgtcgg

SEQ ID NO: 200873 - DNA, 510 bp, Homo sapiens
  misc_feature: GYAE6OF01EY0A0.21.46.E02.1.454.CMB.1.raw
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagacggcctnagagactcccgngagcgtattctcgtggcctccagctcgaggacagcagtcacgttnactatnagtagaacgtcaaggcaggacggacgagctgacttattactagtacaacagtaagacagtagagtctagagttgggtgttcggcggaggaccagctacggccgtcgtagtcgacgccaaggctccgccccgttcgg

SEQ ID NO: 200874 - DNA, 515 bp, Homo sapiens
  misc_feature: GYAE6OF01CUXVQ.21.46.E02.1.454.CMB.1.raw
  modified_base (312)..(312): a, c, t, g, unknown or other
  misc_feature (312)..(312): n is a, c, g, or t
  modified_base (366)..(366): a, c, t, g, unknown or other
  misc_feature (366)..(366): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaaccaacagaagccaggccaggcccctgtgttagtgatatataaagacactgagagccctnagagactccctgagcgattctcgtggctccagctcgaggacagcagtcacgttnactatcgagtagaagtccgaggacaggaggacgaggctgacttatactgtacaacagtagacgagtagaggtactcgagttgggtgttacggcggaggaccgagcgtcgaccgtccgtaggcaccgaccgaggcctcgcccccgttcgg

SEQ ID NO: 200875 - DNA, 514 bp, Homo sapiens
  misc_feature: GYAE6OF01EXHR1.21.46.E02.1.454.CMB.1.raw
  modified_base (313)..(313): a, c, t, g, unknown or other
  misc_feature (313)..(313): n is a, c, g, or t
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctnagagatccctgagcgattctctggctccagctcgagggacagcagtcacgttgactatcagtgaagtccaggcagaggacgaggctgactattactgtacaaacgagtaagacagtaagaggttactcagtttgggngttcgggcggtagggaccgaagcgtggacccgtctaggccagacccaaggctcgcccccgtcgg

SEQ ID NO: 200876 - DNA, 526 bp, Homo sapiens
  misc_feature: GYAE6OF01BPNPB.21.46.E02.1.454.CMB.1.raw
  modified_base (257)..(257): a, c, t, g, unknown or other
  misc_feature (257)..(257): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (418)..(418): a, c, t, g, unknown or other
  misc_feature (418)..(418): n is a, c, g, or t
  modified_base (428)..(428): a, c, t, g, unknown or other
  misc_feature (428)..(428): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaanagaagccaggccaggcccctgtgttagtgatatanaaagacactgagacggccctnaganactccctagagcgtattctctggctccagctcgagggacagcagtcacgttgactatcagtcgaagtccgaaggcaagaggacgaggctgactattacgtnacaacagtanacagtagagtactgagttgggtgtacgggcggaagggacccgaagtcgtacggacccgttccgtaggacacgcccgaaggcctccggcccccgtacgg

SEQ ID NO: 200877 - DNA, 244 bp, Homo sapiens
  misc_feature: GYAE6OF01B3XEK.21.46.E02.1.454.CMB.1.raw
  modified_base (243)..(244): a, c, t, g, unknown or other
  misc_feature (243)..(244): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttccctcgtctctacgagcgggctggcaaggcgcatagnn

SEQ ID NO: 200878 - DNA, 523 bp, Homo sapiens
  misc_feature: GYAE6OF01B9Y5F.21.46.E02.1.454.CMB.1.raw
  modified_base (244)..(244): a, c, t, g, unknown or other
  misc_feature (244)..(244): n is a, c, g, or t
  modified_base (429)..(429): a, c, t, g, unknown or other
  misc_feature (429)..(429): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaattangtcttattggtaccaacagaagccaggccaggcccctgtgtagtgatatataaagacactgagaggccctcagagactccctgagcgattctctggctccagctcgagggacagcagtcacgttgactatcagtgaagtcaggcaggagacgaggctagactagttactgtacaaacagtaaganagtagagtactacgtagttgggtgtcggacggagggaccgagcgtcgtaccggtccgtacggtcacgacccgaaggtcctcgcccccgtacggg

SEQ ID NO: 200879 - DNA, 814 bp, Homo sapiens
  misc_feature: GYAE6OF01BSGRQ.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggacggccaggatccactgctctgcagatggactgacaaagaatntgacttattcggtaaccaaacgagaagccgaggaccgacggcccctggtcgttagtgataataagtaaagacacgtagagacggccctagaacgagactcccgtagacgtacgtacttcgtcgtcgggtccttccgacgtcctacggaacggggaaccacggaccgtaacggttaccgtaacgggtttcgtaaaccgttagttaccgtaagggttacgtaaaaccggttacccggaaacgggtacccgtaaaggggaacgggaaccggtaacggggtaccttaacggggttaaactttaaccgtttaacgtacggttaaaccgtaaaacggtaacggttaacggaaccgtaaagggtttaacgggtaaacgggtttaaccgttaccggtttaaagggttttccggggggttaacgggtttaccccgggggtaagggggtaaaacccggggttacccggaaaacgggttcccggtaacgggtaaaccccgggttacccggttaaccgggttaaccggaacccggtaccccggtaaaccgggcccgttaccccgggtaccccccggttacccggg

SEQ ID NO: 200880 - DNA, 508 bp, Homo sapiens
  misc_feature: GYAE6OF01EI907.21.46.E02.1.454.CMB.1.raw
  modified_base (363)..(363): a, c, t, g, unknown or other
  misc_feature (363)..(363): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctcagctcagggacagcagtcacgttnactatcagtgaagtccaggcagaggacgaggctgactattactgtacaaacagtagacagtagaggtactgagttgggtgttcgggcggagggaccaaggctaggacccgtccgtaggccagacccaaggcctcgcccccgtcgg

SEQ ID NO: 200881 - DNA, 558 bp, Homo sapiens
  misc_feature: GYAE6OF01C4PD9.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctgcagatggactgaccaaaagaaatntgcttattggtaaccaacagaagccaggccaggcccctgtgttagtgatataataaagacactagagaggccctacagagactcccgtgagcgattctctaggccttccagtctcgagggacagcagtcacgttgactatcgaagtgaacgtccaggcaaggaggacgaggcgtagacttagttactgtacaagagtagaacgtaggtagaggtactgtagttgggtcgttacgggacgggtaggaccgaagtcgtacggtacccggtaccgtacggtcgaccggacccgaaggtccctccggcccccgttaccggg

SEQ ID NO: 200882 - DNA, 517 bp, Homo sapiens
  misc_feature: GYAE6OF01CDW3U.21.46.E02.1.454.CMB.1.raw
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatntgcttattggtaccaacagaagccaggccaggcccctgtgttagtgatatataaagacactgagagccctnagagatccctgagcgattctctggcctccagctcgagggacagcagtcacgttgacttatcagtgaagtcaggcagaggacgaggctgactattacgtgtacaaacngtaagacagtagaggttactcgagttgggtgttcgggcggaagggaccgaaggtctggaccgtcctaggtccacgacccgaaggcctcgcccccgtcgg

SEQ ID NO: 200883 - DNA, 560 bp, Homo sapiens
  misc_feature: GYAE6OF01BIP8S.21.46.E02.1.454.CMB.1.raw
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgacttattacggtaaccaacaagaagccaggccacggcccctgtgttagtgataatataaagacactagagacggcctnaganactccgtgagcgattctcgtgctcagctcgagggacagcagtcacgttcgaactatcgagtagaacgtccgaaggcgaaggtacggacgaggtcgtagtacttagttactagtacaaacgtagtaagaacgagtaagtaggtactacgtagttgggtgtcggacgggagggtaccgaagtccgtacggtaaccgtcgtaaggtccacggacccaagggcctccgcccccgtcgg

SEQ ID NO: 200884 - DNA, 527 bp, Homo sapiens
  misc_feature: GYAE6OF01AWU61.21.46.E02.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctnagagactccctgagcgattctctggcctccagctcgagggacagcagtcacgttgactatcagtgaagtccaggcaagaggacgaggctgacttattacgtgtacaaacgagtagacgagtagaggttactcgtagttgggtgttacgggacgggagggaccaggtctaggacccgtacgtaggtcacggacccgaaggcctccggccccgtacgg

SEQ ID NO: 200885 - DNA, 519 bp, Homo sapiens
  misc_feature: GYAE6OF01AFVNG.21.46.E02.1.454.CMB.1.raw
  modified_base (315)..(315): a, c, t, g, unknown or other
  misc_feature (315)..(315): n is a, c, g, or t
  modified_base (375)..(375): a, c, t, g, unknown or other
  misc_feature (375)..(375): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacacgtgagacggccctnagacgactccctgagcgattctctggctccagctacgaggacagcagtcacgttgactancgagtagaagtccgaggcagaggacgaggctgactatactagacaagagtagacagtacgagtactcgtagttggtgttcgggacgggaggaccgaggctacggccgtaccgtaggtcacggacccaaggccctcgccccgtcg

SEQ ID NO: 200886 - DNA, 537 bp, Homo sapiens
  misc_feature: GYAE6OF01CMCJK.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataagacactagagaggccctnagagactcctgagcgattctctggctccagctcagggacagcagtcgagttgactatcgagtagaagtccagcaaggaggacgaggctagactattactagtacaaactagtaagacgaaggtagtaaggtacttagagttgggtggttacgggcgggaagggaaccgaggcgtggacccgttacgtacggtacacggacccaaggcctcggtcccccgtaccgg

SEQ ID NO: 200887 - DNA, 554 bp, Homo sapiens
  misc_feature: GYAE6OF01DNBVP.21.46.E02.1.454.CMB.1.raw
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagaggccctcagagatcccctgagcgattctctggctccagctcagggacagcagtcacgttnactatcagtnaagtccagcagaggacgaggcngactattactgtacaaacagtanaacgtagtagaggtactcgtagttagggtcgttacgggcgggaagggaccgaaaaggtccgtaggtaccccggtacgttaacggtacgacggtaccccggaaggtacccgtccggtccccccgttacccggg

SEQ ID NO: 200888 - DNA, 247 bp, Homo sapiens; identical to SEQ ID NO: 200825
  misc_feature: GYAE6OF01CQPP3.21.46.E02.1.454.CMB.1.raw
  modified_base (244)..(247): a, c, t, g, unknown or other
  misc_feature (244)..(247): n is a, c, g, or t

SEQ ID NO: 200889 - DNA, 543 bp, Homo sapiens
  misc_feature: GYAE6OF01AV3GG.21.46.E02.1.454.CMB.1.raw
  modified_base (257)..(257): a, c, t, g, unknown or other
  misc_feature (257)..(257): n is a, c, g, or t
  modified_base (313)..(313): a, c, t, g, unknown or other
  misc_feature (313)..(313): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaanagaagccaggccaggcccctgtgttagtgatatataaagacactgagacggccctnagagactcccgtgacgcgattctctggcctcagctcgagggacagcagtcacgttgactatcagtgacgtcaggcaggaggacgaggctagactattactgtacaaacgngtaagacgtagtagaggtactagtagttgggtacggttcgggacgggtacggaccgacggtcgtacggtacccgtccgtaggtaccgacggacccgaaggcctccggacccccgttccgg

SEQ ID NO: 200890 - DNA, 507 bp, Homo sapiens
  misc_feature: GYAE6OF01B86XN.21.46.E02.1.454.CMB.1.raw
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctcagagatccctgagcgattctctggctccagctcgagggacagcagtcacgttgactatcagtgaagtcccgaggcaggaggacgaggctagactattactgtacaaacagtananagtagagtactcagtgggtgtcggnggaaggacaagntacggccgtctaggtcacgcccgaagccgtcgcccccgtcgg

SEQ ID NO: 200891 - DNA, 515 bp, Homo sapiens
  misc_feature: GYAE6OF01A81Q9.21.46.E02.1.454.CMB.1.raw
  modified_base (412)..(412): a, c, t, g, unknown or other
  misc_feature (412)..(412): n is a, c, g, or t
  modified_base (460)..(460): a, c, t, g, unknown or other
  misc_feature (460)..(460): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctgcagatggactgccaaagaatatgcttattggtaccaacagaagccaggccaggcccctgtgttagtgatatataaagacactgagaggccctcagagatcccctgagcgattctctggcctccgagctcgagggacagcagtcacgttgactatcagtgaagtccaggcagaggacgaggctgactattacgtntaccaaacagtaagactagtaagaggttactcgagttgggtgttcggnggaggaccgagctggaccgtccgtaggtcacgcccaaggcctcggcccccgtcgg

SEQ ID NO: 200892 - DNA, 518 bp, Homo sapiens
  misc_feature: GYAE6OF01ECW6Z.21.46.E02.1.454.CMB.1.raw
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagacggccctcgagagactccctgagcgattctctggctcagctcgagggacagcagtcacgttgactatcagtgaacgtcaggcaggaggacgaggctagactattactgtacaaagngtaagacgagtagagtactgtagttggtgttcggcggaagggaccgagtcgtacggacccgtcgtaggcacgaccgaaggctccgccccgtaccgg

SEQ ID NO: 200893 - DNA, 527 bp, Homo sapiens
  misc_feature: GYAE6OF01EX07T.21.46.E02.1.454.CMB.1.raw
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnaganatcccctgagcgattctctggctccagctcgagggacagcagtcacgttgactatcagtgaacgtccaggcagaggacgaggctagactagttactgtacaaacagtagaacagtagaggtactcgtagttgggtgttcgggcggagggaccgagtcgtaggacccgtccgtaggaccgacgacccgaaggtcctccgccccgttacccgg

SEQ ID NO: 200894 - DNA, 509 bp, Homo sapiens
  misc_feature: GYAE6OF01E3RNX.21.46.E02.1.454.CMB.1.raw
  modified_base (244)..(244): a, c, t, g, unknown or other
  misc_feature (244)..(244): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaaggggtgggtccaggaggcagaactctgggtgtctcaccatggcctggatcccctctactttctccccctccttcactctcctgcacaggctctgaggcctcctatgagctgacacagccaccctggtgtcagtcgtccccaggacagacggccaggactccacctgctctgcagatggactgccaaagaatntgcttatggtacaacagagccagccaggcccctgtgttagtgatatataaagacactgagacggccctcagagactccccgtgacgcgattctctggcctccagctcgaggacagcagtcacgttgactatcagtgaacgtccaggcagacggacgagctgactattacgtgtacaaacngtacgagagtagagtactcagttgggtgtcggcggaggaccgagctcgaccgtcgtagtcacgcccaaggcctcgcccccgtcgg

SEQ ID NO: 200895 - DNA, 563 bp, Homo sapiens
  misc_feature: GYAE6OF01DUVUS.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatccacctgctctgcagatggactgaccaaagaatatgactttattggtaccaacagaagccaggccaggcccctgtgttagtgatatataaagacactgagaggccctcagagactccctgacgcgatttctctggctccgagctcagggacagcagtcacgttgacttatcaagtgaacgtcaggacagacggacgaggctgacttattactgtacaaacgagtagaacgtagtagtaggttactacgtagtttggggtgttacgggacgggacgggacccgtaagccgttacggtaaccccggtacgttcgggtacgacggacccgtaagggccctccggccccccgttaccggg

SEQ ID NO: 200896 - DNA, 501 bp, Homo sapiens
  misc_feature: GYAE6OF01EZ9HF.21.46.E02.1.454.CMB.1.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (316)..(316): a, c, t, g, unknown or other
  misc_feature (316)..(316): n is a, c, g, or t
  modified_base (418)..(418): a, c, t, g, unknown or other
  misc_feature (418)..(418): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgctacaggctctggaggcctcctatgagctgacacagcccaccctcggtgtccagtgtcccccaggacagaccggccaggatcacctgctcgtgcagatggactgccaaagaatntgcttatggtaccaanagaagccaggccaggcccctgtgttagtgatatataaagacactgagaggccctnagagatccctgagcgattctctggctccagctcagggacagcagtcacgttgactatcagtgaagtcaggcagaggacgaggctgactattactgtcaaacngtaagacagtagaggtactcagttgggtgttccggcggagggaccagctgccgtctaggtcagcccaaggcctgccccctcgg

SEQ ID NO: 200897 - DNA, 603 bp, Homo sapiens
  misc_feature: GYAE6OF01DVVI2.21.46.E02.1.454.CMB.1.raw
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (309)..(309): a, c, t, g, unknown or other
  misc_feature (309)..(309): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatntgcttatgtaacaanagaancaggccagccctgtgttagtgatataataaagacactgagacggccctanagagactcccgtgagcgtattcgtacgtggctaccgagcctagagggacagcagtcacgttgactatcagtagaacgtcgaggcaggaggacgaggtactagtacttaagttacgtagttaacaaacgtagttaacgaacgtaagggttaaggaacgttacgttacgtaggttttcggggtacggtttaccgggacgggtaacggggaacccgtaaggcggttaccggaacccggttaccgtacggttaccgaacggtaccccgaagggtccctcccggccccccgttaccggg

SEQ ID NO: 200898 - DNA, 249 bp, Homo sapiens; identical to SEQ ID NO: 200678
  misc_feature: GYAE6OF01BIDDQ.21.46.E02.1.454.CMB.1.raw
  modified_base (243)..(249): a, c, t, g, unknown or other
  misc_feature (243)..(249): n is a, c, g, or t

SEQ ID NO: 200899 - DNA, 560 bp, Homo sapiens
  misc_feature: GYAE6OF01EC7JY.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgacttattggtaccaaacagaagccaggccaggcccctgtgttagtgatatataaagacactgagaggccctnagagatcccctgagcgattctctggctccagctcgagggacagcagtcctagttcgactagtcagtgaagtcgagcgaggaggacgaggctagactattactagtacaaacgtagtaacgacgaagtaaggtagttaacgtactaggtttcgggtgttcgggacgggaagggaaccgaaggtcgtagggtccccgtacgtaggtaccgacggacccgtaacggccgttccgcccccgttacccgg

SEQ ID NO: 200900 - DNA, 539 bp, Homo sapiens
  misc_feature: GYAE6OF01EC4XX.21.46.E02.1.454.CMB.1.raw
  modified_base (217)..(217): a, c, t, g, unknown or other
  misc_feature (217)..(217): n is a, c, g, or t
  modified_base (241)..(241): a, c, t, g, unknown or other
  misc_feature (241)..(241): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcngcagatggactgaccaaagaaatntgcttattggtaccaacagaagccaggccaggcccctgtgttatgatatataaagacactgagaggccctcagagactcctgagcgattctctggctccagctcagggacagcagtcacgttgactatcagtgagtcagcagngacgngctagactattactgtacaaacgtagtaagacgtaggtagacgttactactagttgggtgttcgggacgggagggtacccgaaggtcgtacggacccgttccgtaagggtaccgtacgaccccgtaaggccgttccgcccccgttaccgg

SEQ ID NO: 200901 - DNA, 553 bp, Homo sapiens
  misc_feature: GYAE6OF01D15CK.21.46.E02.1.454.CMB.1.raw
  modified_base (240)..(240): a, c, t, g, unknown or other
  misc_feature (240)..(240): n is a, c, g, or t
  modified_base (440)..(440): a, c, t, g, unknown or other
  misc_feature (440)..(440): n is a, c, g, or t
  modified_base (535)..(535): a, c, t, g, unknown or other
  misc_feature (535)..(535): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaagaaatntgcttattggtaccaacagaagccaggccaggcccctgtgttagtgatatataaagacacgtagagacggccctacaagagactcccgtgagcgtattctctggctccagctacgacgggacagcagtcacgttgactatcagtgaacgtccaggcaaggaggacgaggctagacttattacgtagtacaaacgagtaanacgagtagaagtactacgtgttgggtgttcgggacggacgggaccgtaagcgtacggacccgttaccgtagggtaccacggacccgaaggtcccnccggtcccccgtaccggg

SEQ ID NO: 200902 - DNA, 509 bp, Homo sapiens
  misc_feature: GYAE6OF01BFITI.21.46.E02.1.454.CMB.1.raw
  modified_base (312)..(312): a, c, t, g, unknown or other
  misc_feature (312)..(312): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctnagagatccctgagcgattctctggctccagctcgagggacagcagtcacgttgactatcagtgaacgtcaggcagaggacgagctgactatactntacaangtagacagtagagtactcagttgggtgtcggcggaggaccgaaggtctaggtaccgtaccgtaggtcgacgacccgaaggcctcgcccccgtacgg

SEQ ID NO: 200903 - DNA, 530 bp, Homo sapiens
  misc_feature: GYAE6OF01AE5SP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactggagaggccctcgagagactccctgagtcgattctctggctccagctcgagggacagcagtcacgttgactatcagtgagtcaggcagaggacgaggctagactattacgtgtacaacagtagacgtagtagtaggtactagtagttgggtgttcgggacggtacggacgtaaggcgtcggacccgttaccgtaggtcacggcccgaaggcctccggtccccgtaccgg

SEQ ID NO: 200904 - DNA, 546 bp, Homo sapiens
  misc_feature: GYAE6OF01BT9G4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggccccctgtgttagtgatatataaagacactgagaggccctcagagatcccctgagcgattctctggctccagctcgagggacagcagtcacgttgactatcagtgaagtcaggcaggaggacgaggctgactattactgtacaaacagtaagacgaagtagtaaggtactacgtagttgggtgttcgggacgggtaacgggacccgaagtcgtacggacccggtaccgtaggtaccgacggacccgaagggccctcggcccccgttaacggg

SEQ ID NO: 200905 - DNA, 688 bp, Homo sapiens
  misc_feature: GYAE6OF01BNC0U.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacagcccaccctcggtgtcagtcgtcccaggacaggacggccaggactcacctgctctgcagatggactgacaaagaaatntgtacttatacggtaaccaagagaagcgacggccacgccctgtcgtagtgatataataaacgacacgtgagacggcctacgagagactccgtagacgtcgtacttcgtcgtcggcctaccgacgtccgtacgaacggggacacgacgtacgtaccgtacgttacgaacttagtacgaggtacgtaacgtacccgaaggacgaagggaacggacggaggtacgtacgtaacttaacttacgtaacgtaaccgaaacgtaggtaacgaacgtaaggtaaacggttaggttaacctacggttagggtttacggggttacggttaccggggacggggtaaacggaacccggtaaaggcccggttaacgggtacccggttacccggttaacgggaccgtaacccgggacccggaacccgggttcctaccccgggtcccccggttaccggg

SEQ ID NO: 200906 - DNA, 504 bp, Homo sapiens
  misc_feature: GYAE6OF01BX703.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctcagagatccctgagcgattctctggctcagctcagggacagcagtcacgttgactatcagtgaagtcaggcagaggacgaggctgactattactgtacaaacagtagacagtaagaggtactcgtattgggtgttcggacggtagggaccgaggctgccgtcgtaggtcacgcccaaggcctgcccccgtcgg

SEQ ID NO: 200907 - DNA, 515 bp, Homo sapiens
  misc_feature: GYAE6OF01CLEGC.21.46.E02.1.454.CMB.1.raw
  modified_base (258)..(258): a, c, t, g, unknown or other
  misc_feature (258)..(258): n is a, c, g, or t
  modified_base (399)..(399): a, c, t, g, unknown or other
  misc_feature (399)..(399): n is a, c, g, or t
  modified_base (440)..(440): a, c, t, g, unknown or other
  misc_feature (440)..(440): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggaaagacggccaggatcacctgctctgcagatggactgccaaaagaaatatgcttattggtaccaanagaagccaggccaggcccctgtgtagtgatatataaagacactgagaggccctcagagactccctgagcgattctctggctcagctcagggacagcagtcacgtttgactatcagtgaagtccaaggcaggaggacgaggntagacttatacgtgtacaaacagtaagacagtagagtactnagttgggtgttcgggacggagggaccagcgtagacccggtctaggcagcccgaaggctccggccccgtggtaccc

SEQ ID NO: 200908 - DNA, 532 bp, Homo sapiens
  misc_feature: GYAE6OF01B3D4Z.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtccaggcagaggacgaggcagactattactgtacaaacagtacgacgtagtagagtactcgtagttgggtgttcgggcgggaagggaccgaaggtcgtacggtacccgtccgtaggtccacggacccgaaggccgtccgcccccgttacggg

SEQ ID NO: 200909 - DNA, 739 bp, Homo sapiens
  misc_feature: GYAE6OF01BR0UY.21.46.E02.1.454.CMB.1.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctgcagatggactgacaaagaatntgcttatggtaccaanagaanccgaggccaggcccctgtgttagtgatatataaagacacgtgaagacggccctagaagacactcccgtagacgtcgtaattcctcgtacggtacctcgacgtccgttaccggaaggggtaccaggaccgtacggttacctacggtttaggtaacctacgttaccgaagggtagtaaacggtccccgtaaagggccaaagggtaagggaacccgggtaagggacctttaacgggtaaacctttaacgtttaaccgtttaacgggtaaacccaaaacgtaagggtaaacgtaaccgtaagggttaaacggtaacgggttaccttacgttaggtttaggggggttaccggttaccggggaacgggggttaaaccgggaccgtaacgggtacccgttacgggtacccccggttacggttaacgggtacccaaccgggttaccccgaagggtttccccgcccgggtcccccccgttacccggg

SEQ ID NO: 200910 - DNA, 542 bp, Homo sapiens
  misc_feature: GYAE6OF01ECOKM.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggccaggcccctgtgttagtgatatataaagacactgagaggccctnagagatcccgtgagcgattctctggctccagctcgagggacagcagtcacgttgactatcagtgaagtccaggcaggaggacgaggctagactattactgtacaaacgagtagacaagtagaggttactacgtagttgggtagttacgggcgggaagggaccgaaaggcgtaggacccgttccgtaaggtaccgacggaccccgaaggtcctaccgcccccgtacgg

SEQ ID NO: 200911 - DNA, 581 bp, Homo sapiens
  misc_feature: GYAE6OF01D1IYC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagatggactgaccaaaagaaatatgctttattggtaaccaacagaagccgaggccacggcccctgtgttagtgatatataaagacactgagacggccctcgagacgactccctgagcgtattcgtcgtggcctcagctcgaggacagctagtcgtacgttgacttatcgtagtagaacgtaccgaggacagggacggacgaggctagacttattacgtagtaacaacgagtagacgtaggtaagaggttactagtaggtttcgggtggttaccgggacgggaagggtaaccgaaggtcgtaccggtccggtccgtaaggccgacggaccccgaaggtcccgtccggcccccgttaccgg

SEQ ID NO: 200912 - DNA, 657 bp, Homo sapiens
  misc_feature: GYAE6OF01EVPAA.21.46.E02.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccaggacagacgcaggntcacctgctctgcagatggactgaccaaagaaatatgtcttatggtaaccaacagaagccaggccacggccctgtgttagtgatatataaagacactgagacggccctanagagactcctagacncgtattctctgctcagctacgagggacagcgagtcacgttgactatcgagtacgtaacgtcccgaaggacaagggaacggtaaccggagggtaccttaggtaacctttaagtttaaccgttaaggtaaccaaaaacgtcggttaaacgaaccgtaagggttaaacggtaacgggtttaacctaccggttaaggttttgggggttaccgttacgggggacggggtaaaccgggacccggtaaagtccggttacgggtaaccccggttaccgttacggacccgtaacggaccccggtaaagggtcccttaccccgggccccccgttacggg

SEQ ID NO: 200913 - DNA, 520 bp, Homo sapiens
  misc_feature: GYAE6OF01D3XLO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgtagtgatatataaagacactgagaggccctcagagatcccgtgagcgattctctggctcagctcagggacagcagtcacgttgactatcagtgaagtcaggcaagacggacgaggctgactattactgtacaaacagtagacgagtagagtactcagttgggtgtacggcggaggaccgaagtcgtacggtaccgtccgttaggactacggacccaagggccctggccccccgttaccgg

SEQ ID NO: 200914 - DNA, 593 bp, Homo sapiens
  misc_feature: GYAE6OF01C15WR.21.46.E02.1.454.CMB.1.raw
  modified_base (241)..(241): a, c, t, g, unknown or other
  misc_feature (241)..(241): n is a, c, g, or t
  modified_base (318)..(318): a, c, t, g, unknown or other
  misc_feature (318)..(318): n is a, c, g, or t
  modified_base (441)..(441): a, c, t, g, unknown or other
  misc_feature (441)..(441): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaaccaacagaagccaggccaggcccctgtgttagtgatataataaagacactagagacggccctanaagagactccccgtgacgcgtatttcctctggcctccagctcgaagggacagcagtcacgttgactatcagtagaagtcaggcaagaggacgagctgacttattactagtacaaagtagtaanaacgtagtagaggttactacgtagtttggggtcgttcgggacgggtaacgggaacccgtaaaggtccgttacgggaaccccggttaccgttaagggaccgtaacccgggaccccggaagggtcccccgttaccggcccccccgttaccgggg

SEQ ID NO: 200915 - DNA, 644 bp, Homo sapiens
  misc_feature: GYAE6OF01AGEWX.21.46.E02.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagactcatctacagggaaaggggtgggtccaggaggccagaactctgggtgtctcaccatggcctggatccctctacttctccccctcctcactctctgcacaggctctgaggcctccgttatgagctgtacacagccaccctggtgtcagtgtccccaggacaggacggccgaggactcgacctgcctcgtgcagatggactgaccaaagaatatgtcttattacggaaccaacagtaacgccaggccaggcccctgtcgttagtgatagtaataaacgacacgtgaagacgcctnagacgactcccgtagacgctacttctcgtgacctacgacgtctacgaagggacagcaggtacacgttagtactactacgtagtagaacgtacgaggacgtaaggaacggacgaggtcgtacgtaacttagtttaacgtacgtaactaaacgtagtaacgagtaagtagtacggttactacgtacggtttgggtacggttacgggtaccgggacgggtaaccggtaagggtccgtacgggtacccggttcggtaaccgggttaccgtaaccggtacccggtaaacgggcccgttccgggtccccccgttaccggg

SEQ ID NO: 200916 - DNA, 498 bp, Homo sapiens
  misc_feature: GYAE6OF01BQ9UT.21.46.E02.1.454.CMB.1.raw
  modified_base (313)..(313): a, c, t, g, unknown or other
  misc_feature (313)..(313): n is a, c, g, or t
  modified_base (397)..(397): a, c, t, g, unknown or other
  misc_feature (397)..(397): n is a, c, g, or t
  modified_base (414)..(414): a, c, t, g, unknown or other
  misc_feature (414)..(414): n is a, c, g, or t
  modified_base (477)..(477): a, c, t, g, unknown or other
  misc_feature (477)..(477): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaatatgcttattggtaccaacagaagccaggccaggcccctgtgttagtgatatataaagacactgagaggccctnagagatccctgagcgattctctggctccagctcgaggacagcagtcagttgactatcagtgaagtccaggcagaggacgaggcngactatctgtacaaacngtaagacagtagagtactgagttggtgttcggcggagggaccaggctggaccgtcgtaggacncgccgaagctcgccccgtcgg

SEQ ID NO: 200917 - DNA, 533 bp, Homo sapiens
  misc_feature: GYAE6OF01EPCKZ.21.46.E02.1.454.CMB.1.raw
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaanagaagccaggccaggcccctgtgttagtgatatataaagacactgagaggccctnagagactcccgtgagcgattctcgtggctccagctcgagggacagcagtcacgttnactatcagtgaagtcgagcagaggacgaggctgactagttactgtacaaacgngtaagacagtaagagttactactagttcgggtgttacgggacggagggaaccaaggtcctaggcccgtccgtaggtaccacgacccgaaggcctccggccccgtaccgg

SEQ ID NO: 200918 - DNA, 585 bp, Homo sapiens
  misc_feature: GYAE6OF01DK4KO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgacttaattggtaaccaacaagaagccaggccaggcccctgtgtagtgatatataaagacactgagaggccctacgagaagactcccctggacgcgatttctcgtggcttccagctcgagggacagcagtcacgttgactatcagtcgaagtccaggacaagaggacgaggcgtagacttaagttactagtacaacaagtagaacgaagggttagaaggttactacgtaggtttgggtacggttcgggacggggtacgggaaccgtaaggtcgttacggacccggttccgtaagggtactaccgggaccccgaagggtccctccggtcccccggttacccgg

SEQ ID NO: 200919 - DNA, 523 bp, Homo sapiens
  misc_feature: GYAE6OF01CG66H.21.46.E02.1.454.CMB.1.raw
  modified_base (314)..(314): a, c, t, g, unknown or other
  misc_feature (314)..(314): n is a, c, g, or t
  modified_base (429)..(429): a, c, t, g, unknown or other
  misc_feature (429)..(429): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttagtgatatataaagacactgagaggccctnagagactccctgagcgtattctctggccttccagcctacgagggacagcagtcacgttgactatacagtagaagtccaggcaagaggacgaggctagactattacgtgtacaaanagtagacgaagtagagttactgtagttgggtgttcggcggaggacgagcgtaggcccgtccgtaggtcacgccgaaggcctccgcccccgtcgg

SEQ ID NO: 200920 - DNA, 514 bp, Homo sapiens
  misc_feature: GYAE6OF01BFO69.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagacggccctanagagactccctgacgcgtattctctggcctccagctcgaggggacagcagtcacgttgactatcagtgaagtcaggcagaggacgaggctagactattacgtgacaacagtaagacgtagtagagtactcgtagttgggtgtcggcggaggaccgaggctacggccgtccgtaggcacgacccgaggctccgccccgtcgg

SEQ ID NO: 200921 - DNA, 608 bp, Homo sapiens
  misc_feature: GYAE6OF01AFC0K.21.46.E02.1.454.CMB.1.raw
  modified_base (330)..(330): a, c, t, g, unknown or other
  misc_feature (330)..(330): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacggccaggatcacctgctctgcagatggactgaccaaaagaaatatgcttattacggtaaccaacagaacgccacggccacggcccctgtacgttagtgaataataataaacgaacacgtagaggacgccctanagagactcccgtagacgcgtacttctacgtcggcctccgacgctacgacgggacagcgacgtctacgttacgacttatacgtaggtagaacgtccgaaggacgaaggtaggaaccggaggtctacgtaacttaattacgtagtaaccaaactagtaacgaagaggttaacgaacgttacttacgtaggttgggtacggttcgggacgggacggaccgtacgtcgtacggtaccgtaccgtagtaccgacggccgaaggcctacccggccccgtaccgg

SEQ ID NO: 200922 - DNA, 546 bp, Homo sapiens
  misc_feature: GYAE6OF01DEGUO.21.46.E02.1.454.CMB.1.raw
  modified_base (280)..(280): a, c, t, g, unknown or other
  misc_feature (280)..(280): n is a, c, g, or t
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgngttagtgatatataaagacactgagaggccctcaagagatccctgagcgattctctggctccagctcgagggacagcagtcacgttgactatcagtgaagtccaggcagnggacgaggctagactattacngttacaaacagtagaactagtagaggtaactctagttgggtacgttcgggacggaggggtaccaaaggtctacggacccggtaccgtaagggcctaacggtaccccgaagggtcctccggtccccccgtaccggg

SEQ ID NO: 200923 - DNA, 623 bp, Homo sapiens
  misc_feature: GYAE6OF01DJJ7V.21.46.E02.1.454.CMB.1.raw
  modified_base (243)..(243): a, c, t, g, unknown or other
  misc_feature (243)..(243): n is a, c, g, or t
  modified_base (321)..(321): a, c, t, g, unknown or other
  misc_feature (321)..(321): n is a, c, g, or t
  modified_base (395)..(395): a, c, t, g, unknown or other
  misc_feature (395)..(395): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagatggactgacaaagaatangcttattggtaaccaacagaagccaggaccaggccccctgtgttacgtgaatataataaagacactagagaggccctnagaagactccccgtgacgcgactttctcgtcggccttccgagtcgtacgaaggggacagcgaagtctaacgttnaacttatccaagtagaacgtccgaggacaaggacggacgaggctagacttattacgtagtacaaacgtagtaagaacgtaggtaagagttactacgttaggttggggttacggttcggggacgggtacgggtaacccgaaagggtccgttacggtacccgttacccggttacgggttaaccgacccggtaacccgaagggtccccgtccgtccccccggttacccggg

SEQ ID NO: 200924 - DNA, 517 bp, Homo sapiens
  misc_feature: GYAE6OF01ADYA4.21.46.E02.1.454.CMB.1.raw
  modified_base (241)..(241): a, c, t, g, unknown or other
  misc_feature (241)..(241): n is a, c, g, or t
  modified_base (374)..(374): a, c, t, g, unknown or other
  misc_feature (374)..(374): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatntgcttattggtaccaacagaagccaggccaggccccctgtgttagtgatatataaagacactgagaggccctacagagactccctgagcgattctctggctccagctcgagggacagcagtcacgttgactancagtagaagtccaggcagaggacgagctgacttatactgtacaaacagtaacgacgagtaagagttactacgtagttgggtgtcggacggaggaccgagcgtggacccgtcgtagtcacgacccgaaggctccgccccgtcgg

SEQ ID NO: 200925 - DNA, 557 bp, Homo sapiens
  misc_feature: GYAE6OF01AHFD9.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgcagatggactgccaaagaaatntgcttattggtaccaacagaagccaggccaggcccctgtgttagtgatatataaagacacgtgagacggccctgagagactcccgtagagcgtattctcgtggctccagctcgagggacagcgagtctacgttagacttatacgagtagaacgtccaagggcaaggacggacgaggtctagtactagttactgtacaaacgtgtagacagtagagtactgtagttgggtgttcggacggtaggaaccgtaggtccgtaggtacccgtacgttagggtaccgacggaccccgaaggccgttccggcccccgttccgg

SEQ ID NO: 200926 - DNA, 523 bp, Homo sapiens
  misc_feature: GYAE6OF01BRSPR.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctnagagatccctgagcgattctctggctccagctcagggacagcagtcacgttgactatcagtgaagtcaggcagaggacgaggctagactattactgtacaacagtagacgaagtagagttactcgtagttgggtggttcggacgggagggaccgaaggtcgtacggaccgtaccgtaggtcacgcccgaaaggccgtccgcccccgtcgg

SEQ ID NO: 200927 - DNA, 569 bp, Homo sapiens
  misc_feature: GYAE6OF01C9P13.21.46.E02.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgctttaattggtaaccaaacagaagccaggccaggcccctgtgttagtgatataataaagacactagagaggccctnagagatcccctgacgcgattctctggcctccagctcaggggacagcagtcacgttgaactatcagtagaagtccgaggcaagaggacgaggctagactatttactgtacaaacagtaagacgaagtagaggtactactagttgggtggttcgggacgggtaaggggaaccgaaaggacgtacggtaacccggttaccgttacgggtaccgtaacggaccccgaagggcccttccggccccccgttccgg

SEQ ID NO: 200928 - DNA, 538 bp, Homo sapiens
  misc_feature: GYAE6OF01ENDQP.21.46.E02.1.454.CMB.1.raw
  modified_base (236)..(236): a, c, t, g, unknown or other
  misc_feature (236)..(236): n is a, c, g, or t
  modified_base (275)..(275): a, c, t, g, unknown or other
  misc_feature (275)..(275): n is a, c, g, or t
  modified_base (412)..(412): a, c, t, g, unknown or other
  misc_feature (412)..(412): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctctatgagctgacacagccaccctggtgtcagtgtccccaggacagacggccaggatcacctgctctgcagatggactgccaaagaatntgcttatgtacaacagaagcagccagcccctgtgttagngatatataaagacactgagacggccctacgagagactccctagagcgaattctcgtgactccagctcgagggacagcagtcagttagactatcgagtagaacgtcaggcaagaggtacgagactagacttattactntacaaacagtaacgaacagtagaagttacactagttgggtgttcgggacggtagggaaccgaggtacgtagtacccgtacgtaggtccgaacgaccccgaaaggtccgttcgccccccgttacggg

SEQ ID NO: 200929 - DNA, 501 bp, Homo sapiens
  misc_feature: GYAE6OF01CNUUQ.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattaggtaccaacagaagccaggccaggcccctgtgttagtgatatataagacactgagacggccctnagagatccctgagcgattctctggcctcagctcgagggcagcagtcacgttgactatcagtgaagccaggcaggaggacgaggctagacttattactgtacaaatagtagaacgagtagagtactgtagttggtgtcggaggaggaccgagctggaccgtcgaggcagcccaagcctcgcccctcg

SEQ ID NO: 200930 - DNA, 535 bp, Homo sapiens
  misc_feature: GYAE6OF01E11RQ.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttatggtaccaacagaagccaggccaggccccctgtgttagtgatatataaaagacactgagaggccctnagagatcccctgagcgattctctggctccagctcgagggacagcagtcacgttgactatcagtgaagtccaggcagaggacgaggctgactattactgtacaaacagtaagaacgtaaggtaagtaaggtactagtagttgggtgttcgggcgggaagggaccgaaggtctaggacccgtacgtaggtcgaacgcccgaaagggccctcccgcccgtacccgg

SEQ ID NO: 200931 - DNA, 602 bp, Homo sapiens
  misc_feature: GYAE6OF01B3KD3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtactggtcatccatgacggccagtcgacgacacgtccgggatcccgtagagagacttctctcgcctccagcctcgagggacagtcggacctaccttgactagtcgaggtcgggcccagggtcggacgagtgaagctagtacttactagttcgtacgacacgacgaactaggttagtaggtactagttcggaagggggttacttcgggacgggtacgggtaactaacgggttcgtaacccggttcgttaggtacgacggtaccccgtaaagggtcccgttccggtaccccccgttacgggtaccctaccgttccgttacccccg

SEQ ID NO: 200932 - DNA, 244 bp, Homo sapiens
  misc_feature: GYAE6OF01C3Q9M.21.46.E02.1.454.CMB.1.raw
  modified_base (242)..(244): a, c, t, g, unknown or other
  misc_feature (242)..(244): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaggactacttccctcgtctctactgagcggctggcaaggcgcatagnnn

SEQ ID NO: 200933 - DNA, 590 bp, Homo sapiens
  misc_feature: GYAE6OF01EMXTM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacagccaccctggtgtcagtcgtccccaggacagacggccaggatcacctgctctgcagatggactgaccaaagaatatgcttatcggtaaccaacagaacgccaggccacggccccttgtgttagtgatataataaagacactgagacggccctagagagactcccgtagacgcgtacttctcgtcggcctcgagctacgaagggaccagcgagtcgacgttagactagtacgagtagaacgtaccgaggacgtaggacggacggaggactcgaacttacttacgtagtaaccaaagtagtacgaacgtaggtaagtaggtactacgtaggttgggtcggttacgggacgggtaacggacgtaggtcgttacggacccgtacgtacggtacgacgtacccgaaggttccctccggcccccgttaccgg

SEQ ID NO: 200934 - DNA, 583 bp, Homo sapiens
  misc_feature: GYAE6OF01B7QBQ.21.46.E02.1.454.CMB.1.raw
  modified_base (318)..(318): a, c, t, g, unknown or other
  misc_feature (318)..(318): n is a, c, g, or t
  modified_base (340)..(340): a, c, t, g, unknown or other
  misc_feature (340)..(340): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatatgacttattaggtaaccaacagaagccaggccaggcccctgtgttagtgaatataataaagacactgagacggccctnagagatccctgagcgtattctntggctccagctcgagggacagcagcacgttgactatcgagtgaagtccaaggcaagaggacgaggctagactattacgtagtaaccaaacagtaacgacgaagtaagaggtacttacgaggttgggtggttaccgggacgggaaggggtaacccaaaggtccgtagggtaaccccggtaccgttaacgggttccgaaaccggacccctaaaggggcccttcccggtaccccccggttaccggg

SEQ ID NO: 200935 - DNA, 788 bp, Homo sapiens
  misc_feature: GYAE6OF01C8SOC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctgcagatggactagaccaaaagaatatgtactttagttacggtaaccaacgaaggaacgaccgacggaccacggtccccgtgttggttaagtgaattaataagtaaacgactaacgtaggaggaccggaccctagaggaacgacttacccgtaggacgtcggtactttcgtcgtcggacctccgaacgtcctacggaaggggaccacggacgtaacgttaccgtaacggtttacgaaccgtttactaaccggtaaggttacggaaacggttcccggaagggtacggaacggaacggggaccgacgggtacgttacggtaaactttacgtttaacggtacggttaaaccaaacgtaagggttaacaaacggtaacgggttaagggtaacgtttaacccgttaggttaagggttttcggggtaccgggttacgggggacccggggtaaacgggacccggttaaacgggcgtttacccggggtacccggtttaacccggtaagggttaccccgaacggggtaacccccgtaacggggttccccgttaccccgggcccccccggtttaacccggg

SEQ ID NO: 200936 - DNA, 510 bp, Homo sapiens
  misc_feature: GYAE6OF01A54VZ.21.46.E02.1.454.CMB.1.raw
  modified_base (479)..(479): a, c, t, g, unknown or other
  misc_feature (479)..(479): n is a, c, g, or t
  modified_base (498)..(498): a, c, t, g, unknown or other
  misc_feature (498)..(498): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagattcattgaccaaaagaatatacttgttggttccagcagaagtcaggccaggcccctgtactggtcatccatgaggccagtcgacgacactccgggatccctgagagattctctgcctccagcctcgagggacagtcggcctaccgttgactatcgaggtcgggcccgagggtggacgagtgaagctgactatattgtacgcacagacagtagtgtcagtcgaggggtatcgggacgaggactagtcgacgtcgtgtncgccagctcgcccctcgcnctcgtcgtcccc

SEQ ID NO: 200937 - DNA, 565 bp, Homo sapiens
  misc_feature: GYAE6OF01EDMSB.21.46.E02.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtcttattggtaaccaacagaagccaggccaggcccctgtgttagtgatatataaagacactgagacggccctanagagactcccgagacgcgtattcctcgtggcctccacgctcgaagggacagcagtctacgttgactatcagtagaacgtcaggcaggacggacgaggctagtacttattacgtacgtacaaacgagtaagacgaagtagtagtactacgtagtttgggtaggttcgggacgggaaggaccgtaacggtcgtacggacccgttaccgtaggacctacggacccgaacgggtctcccgccccgtaccgg

SEQ ID NO: 200938 - DNA, 508 bp, Homo sapiens
  misc_feature: GYAE6OF01A6QUJ.21.46.E02.1.454.CMB.1.raw
  modified_base (419)..(419): a, c, t, g, unknown or other
  misc_feature (419)..(419): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgtagtgatatataaagacactgagacggccctcagagatccctagagcgattctctggcctccagcctcgagggacagcagtcacgttgactatcagtagaagtcaggcaggagacgagctgactatactagacaacgngtagacagtagagtactgtagttggtggttcggcgggaggaccgagcgtcggaccgtcgtagtcgacgaccgaagcctcgccccgtcgg

SEQ ID NO: 200939 - DNA, 510 bp, Homo sapiens
  misc_feature: GYAE6OF01BFRIA.21.46.E02.1.454.CMB.1.raw
  modified_base (311)..(311): a, c, t, g, unknown or other
  misc_feature (311)..(311): n is a, c, g, or t
  modified_base (446)..(446): a, c, t, g, unknown or other
  misc_feature (446)..(446): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctnagagatccctgagcgattctctggctccagctcagggacagcagtcagttgactatcagtgaagtccaggcagagacgaggctgactattacgtgtacaaatgtagacgaagtagaggttactacgagtttgggngtttcgggcggagggaccaagctcgaccgtcgtagccgagacccgaaggcctcgcccccgtcgg

SEQ ID NO: 200940 - DNA, 555 bp, Homo sapiens
  misc_feature: GYAE6OF01CN4SK.21.46.E02.1.454.CMB.1.raw
  modified_base (241)..(241): a, c, t, g, unknown or other
  misc_feature (241)..(241): n is a, c, g, or t
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatntgcttaattggtaaccaacagaagccaaggccaggcccctgtgttagtgatatataaagacactgagaggccctnagagatccctgagcgattcnctggcctcagctcagggacagcagtcacgttgactancagtgaacgtcaggcaaggacggacgaggctagactatttactgtaacaaacgtagtaacgactaaggtagaaggttactacgtaggttgggtgttcggggacggagggaaccgaaggtcctagggtaccccgttccgtaaggtcccgacggcccaaagggcctcccgggtccccctccggg

SEQ ID NO: 200941 - DNA, 535 bp, Homo sapiens
  misc_feature: GYAE6OF01D1787.21.46.E02.1.454.CMB.1.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (314)..(314): a, c, t, g, unknown or other
  misc_feature (314)..(314): n is a, c, g, or t
  modified_base (445)..(445): a, c, t, g, unknown or other
  misc_feature (445)..(445): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgcttattggtaccaanagaagccaggccaggcccctgtgttagtgatatataaagacactgagaggccctnagagatccctgagcgattcgtctggctccagctcgagggacagcagtcacgttgactatcagtgaagtcgaggcaggaggacgaggctggacttattactgtacaaacgagtagacagtaagaggttactnagtttggtggttcggacgggtaggaaccgaggccgttaggcccgtaccgtaggtccaacggaccccgaaggccctcgcccccgttcccgg

SEQ ID NO: 200942 - DNA, 501 bp, Homo sapiens
  misc_feature: GYAE6OF01AL4KL.21.46.E02.1.454.CMB.1.raw
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagactcctgagcgattcnctggctccagctcgagggacagcagtcacgttgactatcagtgaagtccgaggcaggaggacgaggctgactattacgtgtacaaacagtagacagtagaggtactgagttggtgtcggcggagggaccagctagccgtcgtaggcacgccaaggcctcgccccgtcgg

SEQ ID NO: 200943 - DNA, 720 bp, Homo sapiens
  misc_feature: GYAE6OF01EQXON.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttatggtaccaacagaagccaggccacggcccctgtgttagtagatataataaagacactgagacggccctagagagtactccgtggacgcgtattcctcgtcggtcctaccgagtcctacggaacggggtaccaacggtacacggttccgtaacgcttttaggacccttaagttccgaaaggtttccgaaaagggttccccaagggccgaacggaaggggaaccgtagggaccttaggtaacccgttaagtttaaccgtaacgtaactaaaacggaacgtaacggtaacgtaagggttaacgtaacgggttaaccgttacgggtaaggttttcgggggtacgggtttacggggaacccggggtaaacggggtacccgtaaagggtacccggttaccggtaacccgggttaccccgtaacggggtacccgtaacgggacccccgtaacggggtcccccgttccgggtacccccccg

SEQ ID NO: 200944 - DNA, 802 bp, Homo sapiens
  misc_feature: GYAE6OF01A1SBX.21.46.E02.1.454.CMB.1.raw
  modified_base (124)..(124): a, c, t, g, unknown or other
  misc_feature (124)..(124): n is a, c, g, or t
  modified_base (157)..(157): a, c, t, g, unknown or other
  misc_feature (157)..(157): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (498)..(498): a, c, t, g, unknown or other
  misc_feature (498)..(498): n is a, c, g, or t
tcagtcgtcgctcgcacgaccggtgctcgatttagactcatctacagggaaaggggtgggtccaggaggcagaactctgggtgtctcaccatggcctggatccctctacttctcctccctctcnctctctgcacgagcctgaggcggcctacctagngcgtcagacacgcgccctcccgtggtntacngttccgaccccgaggacaggaccggaccgaaggtactacctacctcgtccttcgcgacaaagttagtcgggactacgaaaccgtaaaaaggtaaattactcggttacttttaggtttaccggaaacccaaacgaaggaaccgccgacggacccgaaccgggttccccttggtaggtttagataattaataaacgtaaaacggcctagtaggaacgggaccgccctaggaaggaacgtacccttccgaggacggtacgttacttccgttcggtaacggccctacccgaagttccaacggggaacgggaacncgtttacgaacgttccgttaacggttacgaacttacgtaggaggttaaggaaaccgtcccggaaggacgaaagggaccggtttagaccgggtctaacggtaacctttaagtttaccgagaaaccgaaagtacggtaacgaacggtagttaagggacttaccgtaagtaggggtttagggtttaccggcgggggaaaccgggttaacggaccgttaagggtccgttacccgggtaacccccgttagggttacgacccggaacccgaaaccccgggagggttccctcccccgggttaaccccccgg

SEQ ID NO: 200945 - DNA, 526 bp, Homo sapiens
  misc_feature: GYAE6OF01BF3B1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacacgtgagacggccctgaagagactcccgtagacgcgtattctcgtggctcagctcgagggacagcagtcacgttgactatcagtagaagtccaggacaggaggacgaggctagacttattactgtacaaacgtgtagacaagtagagtactacgtagttgggtgtcggcggaacgggacgagcgtacggaccggtctaggacacgacccaaggctccgccccgtcg

SEQ ID NO: 200946 - DNA, 501 bp, Homo sapiens
  misc_feature: GYAE6OF01BCZVT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggccccctgtgttagtgatatataaagacatgagaggccctcagagatcccctgagcgattctctggctccagctcagggacagcagtcacgttgactatcagtgaagtccaggcagaggacgaggctgactatactgtacaaacagtagacagtagagtactcattgggtgtcggcggagggaccaagctggaccgtcgtaggtcacgcccaaggcctcgccccgtcgg

SEQ ID NO: 200947 - DNA, 579 bp, Homo sapiens
  misc_feature: GYAE6OF01CBSWK.21.46.E02.1.454.CMB.1.raw
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaaccaacagaagccaggccaggcccctgtgttagngatatataaagacactgagaggccctanagagactccctgagcgtattctctcggctccagctcgagggacagcagtcacgttgactagtcagtagaagtccaggacgaggaggacgaggcgtagaacttagttacgtgtaactaaagagtaagaacaaggttagaacggttactcgtagtttcggggttagttcgggacgggtaagggaacccgaaggtccgttacggacccgttccgtaagggtacccaccggtacccgaacgggtccctccgggccccccgttaccggg

SEQ ID NO: 200948 - DNA, 535 bp, Homo sapiens
  misc_feature: GYAE6OF01CCAEA.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgcttattggtaccaacagaagccaggccaggccccctgtgttagtgatatataaagacactgagaggccctcagagatcccctgagcgattctcgtgctccagctcgagggacagcagtcacgttgactatcagtagaacgtccgaggcgaggagggacgaggctgtactattacgtagtacaaacagtagaacgagtagagttactgtagttgggtggttcggcggtagggaccgaggctacggaccgtccgtaggtaccgacgacccgaggcctccggtccccgtaccgg

SEQ ID NO: 200949 - DNA, 565 bp, Homo sapiens
  misc_feature: GYAE6OF01DNQOJ.21.46.E02.1.454.CMB.1.raw
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaaccaacagaagccaggccaggcccctgtgttagtgatatataaagacactgagaggccctnagagtatccctgacgcgtattctcgtcggcctccagtctcgaaggacagcagtcacgttagactatcagtagaacgtccgaggcaaggaggacgaggctagacttatactgtacaacgagtacgagagtagagtactacgtaggttgggtacggttacgggacgggagggaaccgtaaggtcgtacggtacccggtaccgtaacgggtaccgaccggaccccgaaggcccgtccggccccccgttaccggg

SEQ ID NO: 200950 - DNA, 645 bp, Homo sapiens
  misc_feature: GYAE6OF01EOQIA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctgcagatggactgaccaaaagaaatatgcttattggtaccaacagaacgccagccacggcccctgtgttagtgatatataaagacacgtgagacggcctagagagactccgtagacgcgtattctcgtgtcctcgacgtctacgagggtacagacgtaacgtcgtaacgtttagaacttactacgtaggtagtaacgtaccgaaggacgtaaggaacggaacgggaggtactaggtaacttaacgttacgttacgtaacaaacgtaagtaacgaacgtaaggtaaggtacgttaactacgtaggtttggggttggttaccggggacgggtaaacgggaaccgtaacggtctaaccgggtacccgttacggttaacgggtaccgaaccggtaccccgaaagggcccgtccccggtcccccgttacccggg

SEQ ID NO: 200951 - DNA, 532 bp, Homo sapiens
  misc_feature: GYAE6OF01EMDSF.21.46.E02.1.454.CMB.1.raw
  modified_base (452)..(452): a, c, t, g, unknown or other
  misc_feature (452)..(452): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggccaggcccctgtgttagtgatataataaagacactgagacggccctgagagactccctgagcgattctcgtggctccagctcgagggacagcagtcacgttgactatcagtagaagtccaggacaggaggacgaggctgacttatactagtacaaagagtaagacgtagtaagaggtactanagttgggtgtcggcgggagggaccgagcgtacggtaccgtacgtaggtcgacgcccgaaggtcctcggcccccgttacgg

SEQ ID NO: 200952 - DNA, 552 bp, Homo sapiens
  misc_feature: GYAE6OF01D0KLS.21.46.E02.1.454.CMB.1.raw
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttatggtaaccaacagaagccaggccaggcccctgtgttagtgatataataaagacactgagacggcctagagagactcccgtgagacgtattctctggctcagctcgaggacagcagtcacgtnactatcagtnagtcagacagagagagcagactatactnacaangtagacagtagagtactacgtagttgggtgttacgggcgggtaacgggaccgaaaggtccgttacggtaccccgttaccgtacgggttacccgaacgggtaccccgaagggtcccgtcccggtcccccccgttaccggg

SEQ ID NO: 200953 - DNA, 542 bp, Homo sapiens
  misc_feature: GYAE6OF01AGE1D.21.46.E02.1.454.CMB.1.raw
  modified_base (434)..(434): a, c, t, g, unknown or other
  misc_feature (434)..(434): n is a, c, g, or t
  modified_base (482)..(482): a, c, t, g, unknown or other
  misc_feature (482)..(482): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacgagaagccaggccacggcccctgtgttagtgatataataaagacactgagaggccctacgagagactccctgacgcgtattctcgtggcctccagctcgagggacagcagtcgtacgttgactatcgagtagaacgtccgaaggcgaggaggacgaggctgtacttattacgtntacaaagagtaagacgtaagtagacgtactagtaggttgggtgtcggnggacggacgagcgtcggaccgttccgtaggtccgacgacccgaggcctccgcccgtccgg

SEQ ID NO: 200954 - DNA, 538 bp, Homo sapiens
  misc_feature: GYAE6OF01D53VX.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggccctnagagactccctgagcgattctctggctccagctcaggacagcagtcacgttgactatcagtgaagtcgaggcaggaggacgaggctgacttattactgtacaaacagtagacagtagagttactatagttgggtgttcgggacgggagggaccgaaggtcgtacggtacccggtaccgtaggtaccgacggaccccgaaaggcccgttcggccccccgttacggg

SEQ ID NO: 200955 - DNA, 519 bp, Homo sapiens
  misc_feature: GYAE6OF01ARNOR.21.46.E02.1.454.CMB.1.raw
  modified_base (314)..(314): a, c, t, g, unknown or other
  misc_feature (314)..(314): n is a, c, g, or t
  modified_base (376)..(376): a, c, t, g, unknown or other
  misc_feature (376)..(376): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctanagagtatcccgtgagcgattctctggctccagctacgagggacagcagtcacgttagactanctagtagaacgtccgagcaggaggacgaggctgacctattactgtacaaacagtaagacagtagagtactagagttgggtgttcggacggaggacgagcgtaggaccgtcgtagtcgacgaccgaaggcctcgcccccgtcgg

SEQ ID NO: 200956 - DNA, 628 bp, Homo sapiens
  misc_feature: GYAE6OF01EPO49.21.46.E02.1.454.CMB.1.raw
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctgcagatggactgaccaaaagaaatntgcttatggaccaanagaanccaggccacggccctgtgttagtgatataataaagcacgtgagcggccctnaagagacttcccgtagacgcgtatttcctcgtacgggcctaccgagtcctacgacggggacaggcacgtctacgttgactatcgaggtacgaagtccgaaggacgaggaagggacggaggtctagtacttaattactacggtacaaacgtgtaagaacgtaaggtagtaacggttactcgtaggtttgggtacggttcgggacgggaaacgggacccgtaaggtaccgttaccgggtacccggtaccgttacggggaccgtaaccggaccccggaaacgggttcccgtaccccgggtccccccgtttacccggg

SEQ ID NO: 200957 - DNA, 550 bp, Homo sapiens
  misc_feature: GYAE6OF01D57VB.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgctttattggtaccaacagaagccaggccaggcccctgtgttagtgatatataaagacactgagacggccctcagagatccctgagcgaatttctctggctccagctcgagggacagcagtcaagttgactatcagtgaagtcaggcagaggacgaggctagacttattactagtacaaacagtaacgaacgagtagtacggtactcgtagttgggtggttcgggacgggagggaccgtaaaggtctacggacccgttacccgtagggtaccgtacggaccctaaaggccgttccgcccccgttaccggg

SEQ ID NO: 200958 - DNA, 766 bp, Homo sapiens
  misc_feature: GYAE6OF01B17T3.21.46.E02.1.454.CMB.1.raw
  modified_base (258)..(258): a, c, t, g, unknown or other
  misc_feature (258)..(258): n is a, c, g, or t
  modified_base (712)..(712): a, c, t, g, unknown or other
  misc_feature (712)..(712): n is a, c, g, or t
tcagtcgtcgctcgcacgaccggtgctcgatttagactcatctacagggaaagggggtgggtccaggagggcaggaactcctgggtcgtctcaccactggccttggatccctctacttctcccctcctcactctctgcacaggctctgaggtcctcctatgagtcttgacacagtcctaacccgtcggtgtcagtgtccccaggacagacgccaggactcgaccgtgctcgtgcagtgtcggactgaccaaagaactntgcttagttcggtaaccaacgagtaacgccgtaaggcctaacggtcccctaggttacggtttaagtggtaacttaagttaaacgtaaaacggtaccgtaacgttcggtaacggacgggtccccgtacgtaaacggtaacgttaaccttaccccgttagggaacgtaccggtaacttttccgtaccgttagggtacccctttacccgaaggttacccgttcggtaaacggggaccctacgggtaccgttaaacggttacccggtaaccgtttacgaacccttaacgtaccgtaacggttacgaaacggttacccgaaggtaaccgaaaggtaacggaccgtacgggtctaacggtactacttaccgtaagtaaccaaacgtacgtaacgacgtaagtacggtaacggtactacgtaggttcgggtacgtttacggcgggtaaggtacgaacggtnacggtaccgtcgtaacggtcacggacccgtaaggtcgttcccgccccgttacgg

SEQ ID NO: 200959 - DNA, 547 bp, Homo sapiens
  misc_feature: GYAE6OF01BIUYX.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgacttattggtaccaacagaagccaggccaggcccctgtgttagtgatatataaagacactgagacggccctnagagatccctgacgcgatttcctcgtggcctccgagctcgagggacagcagtcacgttgactatcagtagaagtccgaggcaggaggacgaggctgactattacgtagtacaacaggtagacgtagtaaggaggtactagtagttgggtgtcgggacgggtagggaccaggtcgtacggtacccgtcgtaacggtcgacgaccccgaaggtcccgtccggccccgttaccgg

SEQ ID NO: 200960 - DNA, 811 bp, Homo sapiens
  misc_feature: GYAE6OF01AWCSP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttattggtaaccaacgagaacgccaggccacggcccctgtgttagtgatataataaagacactgagacggccctacgagagactccccgtaggacgtcgtaacttccgttcgtcgggtccttaccgaacggtcctaccggaacgggggacccaacgggtaccgaacggttaccgtaaccgggttttacgaaaccgtttaacgttaccgtaaacgggttaggtaaaccgggttacccggaacgggtaacccggaaagggaacggggtaaccgggaacggggtaccgttaacggtaaacctttaacgttttaaccgttaaccggtaacctaaaaaccggtaaggttaaacggtaaccggttaaaggggttaaccggttaaacgggttaaacccttaccgggttaagggttttacgggggttaccgggttacgggggtacccgggtaaacggggggtaacccgaagggtacccggttaaccggggtaccccggtttaccggtaacgggtaaccgtacccgggtaaccccggtaaacgggtccccgttccccgggtccccccgttacccgggg

SEQ ID NO: 200961 - DNA, 849 bp, Homo sapiens
  misc_feature: GYAE6OF01CNY0A.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctctgcagatggactgaccaaaagaaatatgactttaagttacggtaaccaaacgaaggaaacgcccaaggggcccaacggggtccccccttaggttaggtttaaggtagtaaatttaaagttaaataaaaacggacctaaccgttaggaacggtaaccgggcccccttagaagggaacggtaaccttccccgtaggaacgtccggttaactttcctcgttcgggcctttacccgaaggtcctaccggaacggggacaacgggtaccgaacggtttaccgaacgggttttacgaaccgttaattaccgtaaggttaggaaaaccggttcccggaaacgggaaccggaaaggggaaacgggaaccgggaacggggtaccttaagggtaaaccttttaacgtttaaccgttaggtaaacccgtaaaaacggttaggtaaaacggtaacgtaaagggttaacggtaacggtttaactacggttagggttttacgggggttacgggttacccggggacggggtaaccgggaacccgtaaacgggtcccgttaacgggtaaccccggtaccgtttaacgggcccgaaaccgggacccgtaaacggggtccctaccccgggtcccccccgttaacccggg

SEQ ID NO: 200962 - DNA, 720 bp, Homo sapiens
  misc_feature: GYAE6OF01DQ2X5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgcttattggtaaccaacagaacgccaggccaggccctgtgttagtgatatataaagacactgagaggccctacagacgactcccgtagacgtacgtattcctcgtggcctaccaggtcctacgacggggacaggaccgtagtaccgtaacggttagtaacttacgtaccgtaagttacggaaacgttccccggaaggacgaagggaacgggaacggagggtaccttaggtaacctttaagtttacgtacggttaacaaaacgtaacggttaacgaacgtaaagggttaacggtaaacggttaacccgttacgttagggtttacggggttacgggtttaccggggacggggtaaacggggtaaaccccgtaaagggtccgttaacgggtaacccccggtaaccggtttacgggtaacccgtaccgggtaaccccgaaacggggttcccctcccgggtccccccccgtttacccgggg

SEQ ID NO: 200963 - DNA, 593 bp, Homo sapiens
  misc_feature: GYAE6OF01C59V9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactttctgcacagtctctgaggcctcctatgagctgacacagcccaccctcggtgtcagtcgtccccaggacagacggccaggatcacctgctctgcagatggactgaccaaaagaaatatgactttatttacggtaaccaaacagaagccgaaggcccacggcccctggtgttagtgaatataataaagacactggagacggccctagaagagactcccgagacgcgtattctcgtcggctccgagctcgagggacagcagtctacgttgactatacagtacgaacgtcgaggacgaaggaggacggaggctagtaacttattaccgtagaactaaacgagtaagaacgtaaggtagtaggttacctagttaggttgggtaggttccgggacggacgggaccaacgcggtcggtaccggtccgtagggtcaccggtacccgaaggccctcccgccccgttcggtaccc

SEQ ID NO: 200964 - DNA, 610 bp, Homo sapiens
  misc_feature: GYAE6OF01EYMJ5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagttgacacagccaccctcggtgtcagtcgtccccaggacaggaccggccaaggatcacctgctctgcagatggactgaccaaagaatatgcttattggtaccaacagaagccaggccacggccctgtgttagtgatatataaagacactgagagccctcagagatccctagacgcgtattctcgtcggctccgagtcctacggacggacgagctacggtcgtaacgttacgacttatacgagtagtaacgtccgaaggcgaaggaggaacggaggcgtacgtaacttacgttactacgtaaccaaagaggtaagacgaagtaaggtaaggtacttacgtaggtttggggttcggttacgggacgggtacgggaaccgaacggtcgtacggtacccggtcgttacggacgaccggtacccggaacggtccgtcccggtcccccgtcggtaccccg

SEQ ID NO: 200965 - DNA, 594 bp, Homo sapiens
  misc_feature: GYAE6OF01DK7F1.21.46.E02.1.454.CMB.1.raw
  modified_base (222)..(222): a, c, t, g, unknown or other
  misc_feature (222)..(222): n is a, c, g, or t
  modified_base (378)..(378): a, c, t, g, unknown or other
  misc_feature (378)..(378): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaaacggccaggatcacctgctctgganattcattgaccaaaaagatatacttgttggttccagcaagaagtcaggccaggccctgtactggtcatccatgaggccagtcgacgacacgtccgggatcccgtgagagattctctcgcctccagtcctcgagggcaggtcgcctacgttgactancgaggtcgggcccagggtaggacgagtgaagctagactacttagttcgttacgcaccagacaggtgtgtcagtcgaggggttactcgggacggacggtaaccgtaaggttcggacccggttccgttcgggtaccacggaccccgtaagggcccgttaccggtcccccccgttcgggtaccctaccgttcccgttcccggttcccccttaccccccg

SEQ ID NO: 200966 - DNA, 727 bp, Homo sapiens
  misc_feature: GYAE6OF01CVUCJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccacccgtggtgtcagtcgtccccaggacagacggccaggatcacctgctctgcagatggactgaccaaagaaatatgtacttaagttacggtaaccaaacaggaaacgcccgaacgggacccaacgggcccccttaggttcggtttaaggtaggtaagttaattaaacgttaaaaggacctaacgttaggaaggacggtacccccttagaaggaacgtactaccccgttaggacggtaccgtatttacctccgtagggtccctccgagtccgtacggaacgggacacggacgtacggtaccgtacgtttacggaccttaacgtcgaaggttagaacgtacccgaggaccgaaggacgggacgacggctaacgaactttagtttacgtactaacgaaacgtaaggtaagaaccgtaaggtagtacgttacgtcgtaggttggggttacggttccggggacgggacgggaaccgtaacggtcgttacggtaacccggttaccggtacggtaccgaccgggacccgaacggtcccgttaccccggtcccccgttacccggg

SEQ ID NO: 200967 - DNA, 546 bp, Homo sapiens
  misc_feature: GYAE6OF01CSRV1.21.46.E02.1.454.CMB.1.raw
  modified_base (247)..(247): a, c, t, g, unknown or other
  misc_feature (247)..(247): n is a, c, g, or t
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctcggtgtcagtcgtccccaggacagacggccaggatcacctgctctgcagatggactgaccaaaagaaatatgntttattggtaaccaacagaagccaggccaggcccctgtgttagtgatataataaagacactgagacggccctnagagatccctgagcgtattctcgtggcctccagctcgagggacagcagtcacgttgactatcgagtagaagtccgaggacaggaggacgaggctagacttattactagtacaatagtagactaagtagagtactgtagttgggtgtcgggcggtaaggaccgaggacgtacggacccgttcgtaacggtcgacggacccgaaggtccctccggtcccccgtaccgg

SEQ ID NO: 200968 - DNA, 526 bp, Homo sapiens
  misc_feature: GYAE6OF01AEZYC.21.46.E02.1.454.CMB.1.raw
  modified_base (428)..(428): a, c, t, g, unknown or other
  misc_feature (428)..(428): n is a, c, g, or t
  modified_base (448)..(448): a, c, t, g, unknown or other
  misc_feature (448)..(448): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtgtccccaggacagacggccaggatcacctgctctgcagatggactgaccaaagaatatgcttatggtaccaacagaagccaggccaggcccctgtcgttagtgatataataaagacactgagaggccctgagagactcccgtgacgcgattctcgtggcctccagctacgagggacagcagtcacgttgactatcgagtgaacgtcccgaggcaggaggacgaggctagactagttactgacaaagntaacgactagtagaggtacncgtagttgggtgtcggacggaggaccaggtctagaccggttccgtaggtcacggacccaaggcctccgccccgtacgg

SEQ ID NO: 200969 - DNA, 536 bp, Homo sapiens
  misc_feature: GYAE6OF01CAB24.21.46.E02.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctgagagatccctgagcgtattctctggcctcagctcgagggacagcagtcacgttgactatcagtgaacgtcaggcagaggacgaggctagactattacgngtacaacgagtagactagtagaggtactcgagttgggtgttcgggcggaacgggtaccgaaggtctacggacccgttaccgtaggtaccgaacgcccgaaggccttccggccccccgttaccggg

SEQ ID NO: 200970 - DNA, 696 bp, Homo sapiens
  misc_feature: GYAE6OF01C9UTH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctgcagatggactgaccaaaagaaatatgacttagtggtaaccaacaagaagccaggccacggcccctgtgttagtgataataataaagacactgagacggccctagagacgactcccgtagacgcgtactttccgttcgtcgggccttaccgacgtccgtacggaacggggaacctacggaccgtaacggttaccgtaaccggtttagaacccgttacgtacgtaaggttacgtaaacggttaccccggaagggaacgaagggacgggaacggagggtaccgtagtaacttaagttacgttaacgtaaccaaaacgtaggtaacgaaacggtaaggttaagaacggttaacttacgttaggtttacggggttcggttaccggggaccgggtacgggaaccgaacggttccgtacggtacccggttaccgtacggttaccgaccggtacccggaaggtcccgtccggtacccccgttacgg

SEQ ID NO: 200971 - DNA, 417 bp, Homo sapiens
  misc_feature: GYAE6OF01BOQAP.21.46.E02.1.454.CMB.1.raw
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (401)..(401): a, c, t, g, unknown or other
  misc_feature (401)..(401): n is a, c, g, or t
  modified_base (407)..(417): a, c, t, g, unknown or other
  misc_feature (407)..(417): n is a, c, g, or t
tcagtcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattccgtggggccagggaccctggtaaccgtctcctcagcctccaccaaggcccatcggtcttccccctgcgccctgctccaggngcacctccgagngcacagcggccctgggctgcctggcaaggactacgtcccgagcgacgctgagcgggctggcaggcncatagnnnnnnnnnnn

SEQ ID NO: 200972 - DNA, 518 bp, Homo sapiens
  misc_feature: GYAE6OF01CKVBL.21.46.E02.1.454.CMB.1.raw
  modified_base (240)..(240): a, c, t, g, unknown or other
  misc_feature (240)..(240): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatntgcttatggtaccaacagaagccaggccaggcccctgtgttagngatatataaagacactgagagccctnagagatcctgagcgattctctggctcagctcgaggacagcagtcacgttgactatcagtgaacgtcagcaggaggacgaggctgactatactntacaanagtanactagtagaggtactacgagttgggtgttcgggacggagggaccgaaggtctacggtacccgtcgtaggtaccacggacccgaaggcctcggccccccgttcgg

SEQ ID NO: 200973 - DNA, 551 bp, Homo sapiens
  misc_feature: GYAE6OF01DTL2K.21.46.E02.1.454.CMB.1.raw
  modified_base (243)..(243): a, c, t, g, unknown or other
  misc_feature (243)..(243): n is a, c, g, or t
  modified_base (319)..(319): a, c, t, g, unknown or other
  misc_feature (319)..(319): n is a, c, g, or t
  modified_base (378)..(378): a, c, t, g, unknown or other
  misc_feature (378)..(378): n is a, c, g, or t
  modified_base (433)..(433): a, c, t, g, unknown or other
  misc_feature (433)..(433): n is a, c, g, or t
  modified_base (460)..(460): a, c, t, g, unknown or other
  misc_feature (460)..(460): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatntgacttattggtaaccaacagaagccaggccacggccccctgtcgttagtgatatataaagacactgagagccctnagagactccgtgagcgattctcgtggctccagctcgagggacagcagtcagttgactancagtagaagtccaggcaaggaggacgaggctagacttattactagtaccaaacgngtaacgacgaggtaagaaggttacctntaggttgggtgtccgggagggaacgggaccgaaggtcgtacggacccgtcgtaggccacggacccgaaggcctcccgccccgttacccggg

SEQ ID NO: 200974 - DNA, 583 bp, Homo sapiens
  misc_feature: GYAE6OF01E2N00.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatccacctgctctgcagatggactgaccaaaagaaatatgtacttagttacggtaaccaacaagaacgcccgaggccacggcccctgtgttagtgatataataaagacactgagacggccctgagagactcccgtgacgcgtattctcgtcggctccgacgtctacgagggacacgacgagtcgtacgttcgactagtacagtacgaagtcccgaggcgaggacggacgaggctagacttattactgtacaacgagtagacgtagtagtagtactcgtagttgggtggttccggacgggaaggaccgaaggtcgtacggtacccggttaccgtacggtaccgacgaccccgaacggtccctcccgtcccccggtccgg

SEQ ID NO: 200975 - DNA, 565 bp, Homo sapiens
  misc_feature: GYAE6OF01DOD24.21.46.E02.1.454.CMB.1.raw
  modified_base (431)..(431): a, c, t, g, unknown or other
  misc_feature (431)..(431): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaatatgcttattgtaccaacagaagccaggccagcccctgtgtagtgatatataaagacactagagacggccctgagagactacccctgacgcgtattcctcgtggctccgagctcgagggacagcgagtcacgttgactactcaggtagaacgtcgaggacaaggaggacgaggctgactattactgtacaanaagtagacgagtacgagttacgtacgtagttgggtacggttcggacgggtacgggaccgaaggtcgtacggtaccgttaccgtagggtaccgtaccggaccccgagggtccgtcccggtccccccgttaccggg

SEQ ID NO: 200976 - DNA, 581 bp, Homo sapiens
  misc_feature: GYAE6OF01D0D2S.21.46.E02.1.454.CMB.1.raw
  modified_base (315)..(315): a, c, t, g, unknown or other
  misc_feature (315)..(315): n is a, c, g, or t
  modified_base (436)..(436): a, c, t, g, unknown or other
  misc_feature (436)..(436): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgctttattggtaaccaacagaagccaggccaggcccctgtgttagtgatatataaagacactgagaggccctnaagagatccctgagcgattctactggctccagctacgagggaccagtagtcacgttagactatcgagtgaacgtccaaggcaaggaggaacgaggctagaacttattactagtacaaacgngtaagacaaggttaagaggttactacgtaagtttggggtagttcgggacgggaagggaaccgtaaggtccgttagggaccccggttccgtaacgggtccaaacggccccgaaagggccctacccggccccccgttcgggtacccc

SEQ ID NO: 200977 - DNA, 858 bp, Homo sapiens
  misc_feature: GYAE6OF01AZ9ZP.21.46.E02.1.454.CMB.1.raw
  modified_base (302)..(302): a, c, t, g, unknown or other
  misc_feature (302)..(302): n is a, c, g, or t
tcagtcgtcgctcgcacgaccggtgctcgatttagactcatctacaggaaggggtaggggtaccggagggagggacggaggaacgacgtacgggtggtcgtcgtaccactggccgtggacgtcccgtcctaccttcttcccccttccccttcctacctcctcctcggtaccacacggcgtcctcgtacggtcccttcccttacttcgacggcctacgaccaacgacgccccaccctcgggtcgttctacgtcgttccccagggaccacggacggccgaggactaccaccgtcgtactccgtncgagaagtggacctagaacccaaaaggtaaaactatcgtacgttacgtttaacggaacctaaacaacgaaacggaccgaccggaccggaacccggtccccggttgtaaggtttacggttaacgtaagttaagttaaaactaaacggtaaccgtaccgaggttaacggaaccggtccctaaccgagtaaagaacctttcccggtagacgtacgtaaccgttttctccgtacggcaccccgtagacgtacgaacggggtacccgacgtacaacgttccgtaacgtttacgacttaacgacgtaagtacgttaacgcggtaacgaggaaccggtaaggacgggacggtacggtacgaacttacgtacgttagtaacccgtaaagtcgtaaagggacctaaaggtaccggtaagttaacgtaaccgtaggtttaagggtccggtttaccggggacggaaacgggggttaaaccgacgggttaaacggccggttacccgggtaacgtacgggtaccgtaaccgggaaaccggtccggtacccgggtcgaccccgttcccgg

SEQ ID NO: 200978 - DNA, 545 bp, Homo sapiens
  misc_feature: GYAE6OF01ALHWX.21.46.E02.1.454.CMB.1.raw
  modified_base (319)..(319): a, c, t, g, unknown or other
  misc_feature (319)..(319): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgcttattcggtaaccaacgagaacgccgaggccacggcccctgtgttagtgatataataagacatgagacgccctnagagactcctgacgcgtacttctcgtgcctacngctcgaggacngcagtcacgttgatagtcagtgaactcgaggcaaggaggacgaggcgtagacttattacgtgtacaacgagtaagacgtagtagtagtacacgtagtttgggtgtcgggagggacggaccgtagcggtacgccgttaccgtacggtaccacgacccgaaggcctcccggtcccgttacccgg

SEQ ID NO: 200979 - DNA, 648 bp, Homo sapiens
  misc_feature: GYAE6OF01EO0NJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtctttatcggtaaccaaacagaagccgagccgacgcccctgtgttagtgataatataaagacactagagacggccctagacgagactcccgtgacgcgatttctctcgggtcctccgacgacctcgaacgggtacacgcgaagtcctacggttcgaacttagtacaggtagaaacgtccaagggacgaagggacgggaacgagggtacgtacgtaacgttactttaccgtacggtaaccaaaactaggtaaacgaggtaacgttaaggaacggttaactacggttaggtttacggggttcgggttaccgggtacgggaacgggtaaccgacggtcgtaccggtaccggttcccgtaaggtaccgaccgtacccgaaggccccgtaccgtccccccggttaccgg

SEQ ID NO: 200980 - DNA, 525 bp, Homo sapiens
  misc_feature: GYAE6OF01BMVS8.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagaggccctnagagactccctgacgcgattctctggctccagctcgagggacagcagtcacgttgactatcagtgaagtccgaggcagaggacgaggctgactattactgtacaaacgagtagacgagtagaggtactgtagttgggtgttcggcgggaggaccgaagtcgtacggacccgtcgtaggccacggcccgaaggcctcccggcccccgtacgg

SEQ ID NO: 200981 - DNA, 541 bp, Homo sapiens
  misc_feature: GYAE6OF01BFWHP.21.46.E02.1.454.CMB.1.raw
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
  modified_base (334)..(334): a, c, t, g, unknown or other
  misc_feature (334)..(334): n is a, c, g, or t
  modified_base (414)..(414): a, c, t, g, unknown or other
  misc_feature (414)..(414): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatntgcttattggtaccaanagaagccaggccaggcccctgtgttagtgatatataaagacactgagaggccctnagagatcctgagcgattcnctggctccagctcagggacagcaaggtcacgttgactatcgagtgaacgtccaggacagaggacgaggctgactattacngtacaaagagtagacagtagaagttactcgtagttcgggtgttcgggacggaacgggaccgtaaggctggtaacccgtccgttaagggtccaacggcccaaagggccctcggccccccgttaccggg

SEQ ID NO: 200982 - DNA, 513 bp, Homo sapiens
  misc_feature: GYAE6OF01BOPPE.21.46.E02.1.454.CMB.1.raw
  modified_base (310)..(310): a, c, t, g, unknown or other
  misc_feature (310)..(310): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctgagcgatctctggctccagctcgagggtacagcagtcacgttgaacttagtcagtgaagttcccaaggtcaaggaggacgaggctagactattacagtacaaacngtagactagtagagttacntagttgggtgtcggnggaggaccagctaggtaccgtcgtaggtcacgccaaggcctccgccccgtacgg

SEQ ID NO: 200983 - DNA, 511 bp, Homo sapiens
  misc_feature: GYAE6OF01BS2WV.21.46.E02.1.454.CMB.1.raw
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
  modified_base (398)..(398): a, c, t, g, unknown or other
  misc_feature (398)..(398): n is a, c, g, or t
  modified_base (414)..(414): a, c, t, g, unknown or other
  misc_feature (414)..(414): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatatgacttattggtaaccaacagaagccaggccaggcccctgtgttagtgatatataaagacactgagaggccctnagagatccctagancgattctctggctcagctgaggacagcaggtcacgtgactatcagtgaagtcaggcaagaggacgagcngactatactgacaagngtaagacagtagagtaactcgtagttgggtgttcggcggtaaggacgagcgtacgtaccgcgtaggtcgacgaccgaagtcctcggtccccgtacgg

SEQ ID NO: 200984 - DNA, 575 bp, Homo sapiens
  misc_feature: GYAE6OF01BZ1Y5.21.46.E02.1.454.CMB.1.raw
  modified_base (327)..(327): a, c, t, g, unknown or other
  misc_feature (327)..(327): n is a, c, g, or t
  modified_base (458)..(458): a, c, t, g, unknown or other
  misc_feature (458)..(458): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctgcagatggactgaccaaaagaaatatgtacttattcggtaacccaaacagaacgccaggccacggccccctgtgttagtgatataataaagacacgtgagacggccctnagagactccctgacgcgtattccgtcgtcggcctccgagcctacgacgggacagcagtcacgttgactatacgagtagaacgtccgaggcaaggacggacgaggctgactagttactgtacaacgtagtanacgtaagtagtacgtactagtagttgggtgtcgggacggagggaccgaaggtctcggtacccgtaccgtaggtaccgtacggaccccgtaaggccctcccggtccccgttacccggg

SEQ ID NO: 200985 - DNA, 540 bp, Homo sapiens
  misc_feature: GYAE6OF01EQP8K.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaagacactgagacggccctcagagatcccgtgacgcgattctctggctccagctcgagggacagcagtcacgttgactatcagtgaacgtcaggcaggaggacgaggctgacttattactagtacaaacgagtaagacgaggtaagaggttactacgagttgggtgttacgggcgggaaggaccgaaggtcgtacggtacccgtccgtaggtccgacggacccgaaggcctccgccccgtaccgg

SEQ ID NO: 200986 - DNA, 599 bp, Homo sapiens
  misc_feature: GYAE6OF01CLOJ0.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtgtcccccaggacagacggccaggatccacctgctctgcagatggactgaccaaaagaaatntgcttattggtaaccaacagaagccaggccaggcccctgtgttagtgatatataaagacactgagacggccctacgagagactcccgtaggacgcgtacttctcgtggcctccagctcgacgggacagacagtacacgttgactatcgagtagaacgtccaggcaggaggacgaggtctgtactacttacgtagtacaaacgtgtaacgacgtaagtaggaacggttactacgtaggttacggggttcggttacgggacgggacgggtaaccgaacggtccgttacggtacccggttccgtaagggttaccgaaccggtaccccgaagggtccctcccggtccccccgtaccggg

SEQ ID NO: 200987 - DNA, 836 bp, Homo sapiens
  misc_feature: GYAE6OF01EH6HM.21.46.E02.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagcccaccctcggtntcagtcgtccccaggaccagacggccagggatccacctgctctgcagatggactgaccaaagaatatgtcttagttcggtaacctaacagtaacgccgaggccacggcccctgttacgttagtcgtatataagtaaacgtaccgacgtaggaggacggtcccctagaacgacgtacctcccgtagacgcgtacttccgtacgtacgtacctaccgacgtcctacgaacggggtaccacggtacgtaacggttaccgtaacggtttacgtaaccttagtacccggtaacggttacgtaaaccggttaccccggaaaggtaccgtaaacgggaaccgggtaaccgggtaacgggttacctaacggtaaacctttaacgtttaccgtaacggtaaacccgtaaaacggtaacgggttaacggtaaaccggtaagggttaaacgggtaaccggtttaacgttaaccggtttacgggttttacggggtacgggtttaccccggggaacgggggttaaacccgggtaaacccggtaaaccggtacccgggttacccgggttaaacccccggttacccggttaaacgggtacccccggtaaaccggacccccgggttaaacggggtcccccgttacccccgggtaccccccgtttaacccccgggg

SEQ ID NO: 200988 - DNA, 1199 bp, Homo sapiens
  misc_feature: GYAE6OF01BFD2G.21.46.E02.1.454.CMB.1.raw
  modified_base (251)..(251): a, c, t, g, unknown or other
  misc_feature (251)..(251): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatgctattacgaacctaaaaaaattttnttggttttttacggtaacctaagtaccaaggaacgttacgaacgggacccgtaacgggtccccccgttaggttcggtttcgggttacctaacttccccgtaagttacgggaacggggaaccgtaagggggaaccggaacccgggtaacccccggttacccgggggtaccttacccccggttagggtaaacggtaacggttaacgtttcccgttaccggttccgggtacccgttaaccccgtaaacccggtttacccgggaaacggggggttaaccggggttacccggggtaccccgttaaccggggttttaccgggttaaaccgtttttaccggttaacccgggttaacggggggtttacccgggggggggtaacccccccggttaagggggggtttaacggggggtaaacgggggttaacgggttaaccggggtaaaacgggttaccccggttaacggggttaaaccccgttttaaacccggtttaaacccgggtttaacccgggtttttaaaccccgtttaacccggtaaccgggtaaaccccgtaaacgggtaacccggttaaaccgggtaccgggttaacggggtttaaccggggtttaaacccgggttaaccggggtttaacccgggggtaaaaccgggggggggggtttaacccgtttaaacccgggggttttacccggggggggaaccccggggggtaaacccggggggttaaaccccggggttaacccggggggttttaaccggggttaaacccccggggttttaccccggggtttaaccggggtacccccgggttaaacccgggtaaccccccggggtaaaaccggggttcccccgggttaacccccgggttacccccccccgggtttcccggggtttaacccccggtttaaccccgtttcccccgggtttaaacccccggttttacccccccccccgg

SEQ ID NO: 200989 - DNA, 536 bp, Homo sapiens
  misc_feature: GYAE6OF01C9ML0.21.46.E02.1.454.CMB.1.raw
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (398)..(398): a, c, t, g, unknown or other
  misc_feature (398)..(398): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtgtccccaggacagacggccaggatcacctgctctgcagatggactgaccaaagaatntgcttattggtaccaacagaagccaggccaggccccctgtcgttagtgatatataaagacactgagaggccctnagagactcccctgagcgattctctggctccagcctcgaagggcagcagtccgacgttgacttatcgagtgaagtccagcagngacgaggctagactattactgtacaaacagtagactagtagaggtactagtagttgggttgttacgggcgggagggaccgaagtctacggaccgtaccgtaggtaccgacgacccgaaggcctccgcccccgttacgg

SEQ ID NO: 200990 - DNA, 563 bp, Homo sapiens
  misc_feature: GYAE6OF01EV3SD.21.46.E02.1.454.CMB.1.raw
  modified_base (312)..(312): a, c, t, g, unknown or other
  misc_feature (312)..(312): n is a, c, g, or t
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagacggcctnagagactcctgagcgattctctggctccagctcgagggacagcagtcacgttgactatcagtgaacgtcgaggcaggacggacgaggtctagacttatactgtacaangtaagacgagtagagtactcgtagttgggtggttcgggcgggaagggacccgaaggtccgttaacggtcccggttaccggttaacgggtacccgtaaccgggtacccggaaagggcccgttcccggtccccccggttaccggg

SEQ ID NO: 200991 - DNA, 623 bp, Homo sapiens
  misc_feature: GYAE6OF01CXDLR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgaggcctcctatgagctgacacacgcccaccctcggtgtcagtcgtccccaggacagacggccaggatcaccgtgctctgacagatggactagaaccaaagtaaatatacgtattagttacggtaaccaacagaaacgccgacggccaacggtcccttaggtacgttagtagattaataataaagacactaggacgtacgccctagagacgtactccgtagagtacgtatttcgcgttacgcttaccgagtcacgaggacacggtcaagtcgtaagttgactacgtacgagtagaacgtacgaacgacgtaacggaggacggtacggtacgtagtaactagttaacgtagtaacaaacgtaagtaagacgtaaggtaagtaacggtactagtaggttgggtacggttacgggcggtaacgggacacggtcgtacggaccgtacgaggtaccgacgtaccgagtcccgccggtccccgtaccg

SEQ ID NO: 200992 - DNA, 513 bp, Homo sapiens
  misc_feature: GYAE6OF01A3LEC.21.46.E02.1.454.CMB.1.raw
  modified_base (408)..(408): a, c, t, g, unknown or other
  misc_feature (408)..(408): n is a, c, g, or t
  modified_base (417)..(417): a, c, t, g, unknown or other
  misc_feature (417)..(417): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctcagagactccctgagcgattctctggctccagctcagggacagcagtcacgttgactatcagtgaagtccaggcagaggacgaggctgactattacngtacaaagngtagacagtagagtactcgagttgggtgttcggcggagggaccgaaggtcgtaggcccgtcgtaggtccacgccccaaggcctcgcccccgtacgg

SEQ ID NO: 200993 - DNA, 691 bp, Homo sapiens
  misc_feature: GYAE6OF01DK6SU.21.46.E02.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggaccagacggccaggatccacctgctctgcagatggactagaccaaaagaatntgcttattacggtaaccaacagaacgccaggccacggcccctgtgttagtgatataataaagacactgaagacggccctagagacgactcccgtgacgcgtattcgtctgcctccagcctcgaacggacacgctagtcgtacgtttgaaccttacgtacgtaaggtaggtaaaccgtccgaagggtaccgaagggacgggtaaccgacggtaccgtagtaactttaacgtttaacgtacgttaaaccgtaaacgtaaggttaacgaacggtaaggtaacggtaacggttaaccgttagttagggttcggggtttacgggttaccgggaccggggtaacgggaaccccgtaaagggtccgttaccgggtaacccggtttaccgtaaccgggtacccgtaacggaaccccggacgggttcccgtccccggtcccccggttacccggg

SEQ ID NO: 200994 - DNA, 748 bp, Homo sapiens
  misc_feature: GYAE6OF01BGRWP.21.46.E02.1.454.CMB.1.raw
  modified_base (331)..(331): a, c, t, g, unknown or other
  misc_feature (331)..(331): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctgcagatggactgaccaaaagaaatatgctttaattcggtaaccaacgagaaacgccgaggccaaggccccctgtcggttagtagatataataaacgacactgaagcggccctanagagtactccccgtagacgtcgtatttctacgtggtccctaccgaagccgtaccgaaggggaccagccgtagttaccgtacggttagaacgtaattacgaggttacggaaacggttacccgaagggtaccgaagggtaacgggacgggagggtaccgtaggtaaccttacgtttaaccgttacggttaaaccgaaaacgttacggtaaacggtaaccgtaaagggttaacgggtaaacgggttaacttaccggtaaggttttagggggttacggttcgggggtaaaccggggaacggggtaacccgtaaacgggtccgtaaccgggtaccccggttacccggttaaacgggttcccgaaacccgggtacccccgtaaacgggtccccgtaccccgggtcccccccggtttacccggg

SEQ ID NO: 200995 - DNA, 556 bp, Homo sapiens
  misc_feature: GYAE6OF01B6O0C.21.46.E02.1.454.CMB.1.raw
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgacttattggtaaccaacagaagccaggccaggcccctgtgttagtgatataataaagacactgagaggccctanagagactcctggagcgattcnctggctccagctacgagggacagctagtcacgttgactatacagtagaacgtcgaggcaggaggacgaggtctaggtactagttactagtacaaactgtaagacgtaagtaggaagtactacgtaggttgggtcggttacgggacggaagggaccgaggacgtacggaccggtccgtaggactacggacccgaaggtcctcccggcccccgttaccgg

SEQ ID NO: 200996 - DNA, 829 bp, Homo sapiens
  misc_feature: GYAE6OF01DA7OL.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaagaaatntgctttagttaggtaaccaacgaagaacgccgacggccacggccctgtgttagtgataataagtaaacgacacgtaggacgacggtccctacgagacgactccctaggacgcgtatttcgtcgtacggccttccgacgtccgtacggaacgggtacgaacggtccgaacggttaccgaacgggttttacgtaacttaacgttaccgtaagggttaacgtaaaccgggttaccccgaaagggtaccggtaaaacggggtacggggtaaacccggggtacgggtaacccgttaacggtaaaccgttttaacggttttaacccgtaacggttaaccgtaaaaaccgtaggttaaacgggtaaaccgttaaagggttaaacgggtaacggtttaaccgttaacgggttaggtttttaacggggggtccggtttaacgggggaccgggggttaaaccggggaaccgttaaaccgggttaccgggttaacccggttaaccccgggttacccggttaacggggtaccccgtaaccggggtacccccgaaccgggttaccccggtccccgggttaccccccccggttaacccgggg

SEQ ID NO: 200997 - DNA, 536 bp, Homo sapiens
  misc_feature: GYAE6OF01AOPVN.21.46.E02.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgtacttattcggtaaccaacagaagccaggccacggcccctgtgttagtgatatataaagacagtgagacggccctnagagactccgtgacgcgattctctggcctccagctcgaggacagcagtcagttgactatcgagtagaacgtcgaaggcaggaggacgagctagactatacgtgtaacaagagtacacgagtagagtactgagttgggtgttcggacggtaggaacgacggtcgacggtacccgtacgtaggaccgtacgaccccggaagccgtccgccccgttaccgg

SEQ ID NO: 200998 - DNA, 527 bp, Homo sapiens
  misc_feature: GYAE6OF01BW7WU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaagaaatatgcttattggtaaccaacagaagccaggccaggcccctgtgttagtgatataataaagacactgagaggccctcagagactccctgacgcgtattctcgtggcctccagactaagggacagcagtcacgttgactatcagtgaacgtccgaggacaggaggacgaggtctagacttattactgtacaaacgtagtaagacagtagaggtactgtaagttgggtgtcggaggacggaccgagcgtgaccgtcgagtcacgtcccgaaggcctccgccccgtggtaccc

SEQ ID NO: 200999 - DNA, 770 bp, Homo sapiens
  misc_feature: GYAE6OF01DPKMK.21.46.E02.1.454.CMB.1.raw
  modified_base (244)..(244): a, c, t, g, unknown or other
  misc_feature (244)..(244): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctctgcagatggactgaccaaaagaatntgcttattggtaccaacagaacgccaggccacggcccctgtgttagtagatanaataaagacacgtgagacgccctnagagactcctagagcgtaacttctcgtggctccagctacgaggacctagcctagtcctaacggtttagaacttacgtaccgtaggttacggtaaacgttcccgaagggaccgtaagggaaacgggtaccggaacgggtacgttaacgggtaacctttaaacgtttaacccgtaagttaaaccgtaaaacgtaaccgtttaaacggacgtaacggggtttaacggtaaacggtttaacccgttacgttaaagggttttacggggggtttcggtttacccggggggaaccggggtaaaccggggtaaaccgtaaaaccgggttcccgggtttaacccgggtaaaccccggtttacccgggttaaccggggtaaccccgtaaccgggaaacccccgggtaaacggggttacccccggttcccccgggtaccccccccggttttaacccgggg

SEQ ID NO: 201000 - DNA, 585 bp, Homo sapiens
  misc_feature: GYAE6OF01BNIWJ.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaatatgcttattggtaaccaacagaagccaggccaggcccctgtgttagtgatatataaagacatgagacggccctnagagactccctgacgtcgtaattctctggcctccgagctacgagggacagcagtctacgttgactatcagtagaagtccgaggacaggacggacgaggcgtagtactattacgtagtacaaacgtagtaacgacgtaaggtacgaggttaactcgtaggtttgggtcggttacgggacgggtaacgggtaccgaaggtcgtacggtacccgttccgttaacggtaccgaaccggaccccgaagggtccctcccggtccccccgttacccgg

SEQ ID NO: 201001 - DNA, 744 bp, Homo sapiens
  misc_feature: GYAE6OF01DPOLN.21.46.E02.1.454.CMB.1.raw
tcagtcgtcgctcgcacgaccggtgctcgatttagactcatctacagggaaagggggtgggtccaggagggcagaactctgggtgtctcaccatggcctggactccctctacttcctcccctcctcactctctgcacgaggctcgtggacggtccctctatgagctagacacgacgcccacccgtggtgtcagtccgtccccgaggacacggaccggaccgaggtactaccaccgtcgccttcgtgacgaagtagtcggactacgaaccaaaagaaattagtcgtactttaagttacggtaaaccaacgaaggaacgaccgacggaccgaccggtcccccgttaggttcggttagtagtaagttaataaagtaaacgacacgtagaacggacggtaccctacgaagagtacctcccgtaggacgtacgtactttctcgtcggtcctaccgacgtccgtacggaacggggacacgaccgtaggtaccgtacggtttacgaacttaacgtacgaagtacggaacgtcgaggacaagggacggacggacggtcgtacgattaacgttactacgtaacaacgtaagtacgaacgtaaggtagtaacgttactaggttaggttacggggtcggtacgggaccgggaagggaccgtaaacggtcgttacggtaaccccggttacgggttaccgggtaactaccccgggaaccccggtagggtcccgttccccgggtcccccgttaccggg

SEQ ID NO: 201002 - DNA, 640 bp, Homo sapiens
  misc_feature: GYAE6OF01DSFFW.21.46.E02.1.454.CMB.1.raw
  modified_base (247)..(247): a, c, t, g, unknown or other
  misc_feature (247)..(247): n is a, c, g, or t
  modified_base (266)..(266): a, c, t, g, unknown or other
  misc_feature (266)..(266): n is a, c, g, or t
  modified_base (343)..(343): a, c, t, g, unknown or other
  misc_feature (343)..(343): n is a, c, g, or t
  modified_base (504)..(504): a, c, t, g, unknown or other
  misc_feature (504)..(504): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctctatgagctgacacagcccaccctcggtgtcagtcgtcccccaaggaccaggacggccaggatccacctgctctgcagatggactgaccaaagaatntgctttattggtaaccaanagaagccgaggccaggccccctgtcgttagtgattaataataaagacactagagaggccctacgagaagactccccnggacgcgtattcctcgtaggcctaccacggtctacgaacgggacacgcaggttacctaaggttcgtaactagtacgtaagttaggaaacgttaccgaggtaccgaagggacggtaccgaggtcctaggtaccttatttaccgtagtaaccaaagtacgtanaacgtaggtaagtacggttactaccggtagtttcggggttaggtccgggacgggtaacgggaccgaaggtcgtaccgggaacccgttaccggtaggccgtaaccggacccgaggcccgtccgtccccgttacccgg

SEQ ID NO: 201003 - DNA, 247 bp, Homo sapiens
  misc_feature: GYAE6OF01EMPZG.21.46.E02.1.454.CMB.1.raw
  modified_base (242)..(247): a, c, t, g, unknown or other
  misc_feature (242)..(247): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcctcgtctctactgagcgggctggcaaggcgcatagnnnnnn

SEQ ID NO: 201004 - DNA, 572 bp, Homo sapiens
  misc_feature: GYAE6OF01BRM0X.21.46.E02.1.454.CMB.1.raw
  modified_base (244)..(244): a, c, t, g, unknown or other
  misc_feature (244)..(244): n is a, c, g, or t
  modified_base (504)..(504): a, c, t, g, unknown or other
  misc_feature (504)..(504): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggccttcctattgagctgacacagccaccctcggtgtcagtgtccccaggacagacggccaggatccaccgtgctctgcagatggactgaccaaagaaatntgcttattggtaaccaactagaacgccaagggccaacggccccctggtcgttagtggagtactagtaaagacgacttggagaggccctgagtagagtccctgacgcgtattctactgggcctccgagtcctcgaggggacacgcagtccacgtttcgactatcgaagtcgaacgttccgaaggcaggagacgagcctagacttattactgtacaacgagtaagacgaggtagacggttaactcgtagttgggttgtcggnggaacggtaacgacgtcgacggacccgtctagggtccacggacccgaaggctccgtcccccgtaccgg

SEQ ID NO: 201005 - DNA, 588 bp, Homo sapiens
  misc_feature: GYAE6OF01A6QG6.21.46.E02.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtacttattggtaccaacagaagccaggccaggcccctgtgttagtgatatataaagacactgagagccctanagagactccctgagcgattctctggcctcagtctacgagggacagcagtcacgttgactatcagtagaagtcccgaggcaaggaggacgaggctagtaacttaattacgtagtaacgaaaacgtgtaacgaacgtaaggtaacggtaaggttacgtacgtaggtttaggggtggttacgggacgggaacgggaccgtaaacggccgttacggacccggttaccgtaagggtccaaccggaccccgaaggccgttcccggcccccgttaccgg

SEQ ID NO: 201006 - DNA, 540 bp, Homo sapiens
  misc_feature: GYAE6OF01CKFF2.21.46.E02.1.454.CMB.1.raw
  modified_base (241)..(241): a, c, t, g, unknown or other
  misc_feature (241)..(241): n is a, c, g, or t
  modified_base (368)..(368): a, c, t, g, unknown or other
  misc_feature (368)..(368): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgatatataaagacactgagacggccctcagagactccctgagcgattctctggctccagctcgagggacagcagtcacgttnactatcagtgaagtccgaggcagaggacgaggctagactattactgtacaaacagtaagacagtagtacggtactacgtagttgggtggttacggcgggtagggaccgtaacggcgtacggacccgttccgtacggtcacggacccgaaggcccgtccggcccccgttcggg

SEQ ID NO: 201007 - DNA, 679 bp, Homo sapiens
  misc_feature: GYAE6OF01A1QJ1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttattggtaccaacagagccaggccaggccccctgtgttagtgatataataaagacactgagacggccctcagagatccctgacgcgattctcgtggcctccagcgtcgacgggacaggtcggacccaccgtttcgacttagtccgtaagggttccgggggacccccgtaggggttacggaacggtaacgtggaaacggtcctaggtaaccttacttacgtttacgttacggaccctaacccgagtaccgtaaggttacggtaggttaccgaagtttaccggtaagggggggttacgttccggggaacggggtacggggtaacccggtaaacgggtttcggaacccggtttcccgtttacggggtacccgaaccggtacccggtaacgggtacccctccggtaccccccgtccgggttccctacccggtttccccgg

SEQ ID NO: 201008 - DNA, 706 bp, Homo sapiens
  misc_feature: GYAE6OF01B96UT.21.46.E02.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagactcatctacagggaaaggggtgggtccaggaggcagaactctgggtgtctcaccatggcctggactccctctacttcctcccctcctcactctctgcacgaggctctgacggcctcctatgagctagacacacgcccacccgtcggtcgtcacggtcgaccccaggacacgacggcaggactcacctgctcgngcagagtaggactacggaaccaaaagatagtgtacttagttacggaaccaagagaacgccgacggtaccgtacggtaccctggttagtaagtagaaatttagaaacgtaaacgacctagagacggaccggacccctagaaggacgtaccgtccgtaggacgtccggtaactttctacggtcggtacccacggtaagccgtacgggaacggtacacggtacgtaaggtcccgtaagggtttacgaacctttacgaaggttacggtaacggaaaccgtccgaacgggacgaaacgggaggaccgggtagtccgtaagtaacttacgttacgaggtaaccaaagtacgtaagacgtaaagtacggaacgttctacgtagggttcgggtcggttacgggacggtaaacggacgacgtacgaccggtccgtacgtaaggtcccgaacggacccgtaccggcgttcccggtcccccgttacgg

SEQ ID NO: 201009 - DNA, 814 bp, Homo sapiens
  misc_feature: GYAE6OF01CIXTZ.21.46.E02.1.454.CMB.1.raw
  modified_base (246)..(246): a, c, t, g, unknown or other
  misc_feature (246)..(246): n is a, c, g, or t
  modified_base (298)..(298): a, c, t, g, unknown or other
  misc_feature (298)..(298): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtcgtccccaggacagacggccaggactcacctgctctgcagatggactgaccaaagtaaatntgtcttagttacggtaccaacagaacgccacggccacggcccctgtgttagngtaatataataacgacactgagacggccctagagagactccgtgacgtcgtatttctcgtcggcctaccgacgtccgtacggacggggtacacggtacgtacgttacctaacggtttacgaaccttaacgttaccggtaacggttaacgggtaaaccgttacccggaagggtaccggaacggggaaacgggtaccggggtaacgggttacccgttaacggttaaacccgtttaacgtttaaccgttaaccggtaaacccgtaaaacggtacgggtaaacggtaacggtaaacgggttaacgggttaacgggttaccgttaacggttaggggttttaacgggggttcgggtttaaccgggggaccgggggtaaaccggggtaacccggtaaacgggtacccgggttaaccgggttaacccccgggttaccgttaaaccggggtccccgtaaacccgggtaccccgggtaaaccggggttccccggtacccccgggtacccccccggtttacccgggg

SEQ ID NO: 201010 - DNA, 615 bp, Homo sapiens
  misc_feature: GYAE6OF01BPKM3.21.46.E02.1.454.CMB.1.raw
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctgcagatggactgaccaaagaaatntgacttaattggtaaccaanagaacgccaggccaggcccctgtgttagtgatatataaagacacgtgagacggccctanaagagactccccgtgacgcgtattctcgtcggccttccgagtcctacgacgggacaggcagtcgagttgaactagtcagtagaacgttcccgagggacgaaggacggaacgaggtcgtaaggtaaccttaagttacgttacgtaactaaacgtaggtaacgaagaaggttaagtaacggttacttacgtaggtttgggtaggttcgggacgggtaacgggaccgtaaggtcgtacggtacccgtacgtacggtacgaaccgacccgtaaggtcccgtcccggtcccccgttacgg

SEQ ID NO: 201011 - DNA, 744 bp, Homo sapiens
  misc_feature: GYAE6OF01A3I1S.21.46.E02.1.454.CMB.1.raw
  modified_base (154)..(154): a, c, t, g, unknown or other
  misc_feature (154)..(154): n is a, c, g, or t
  modified_base (249)..(249): a, c, t, g, unknown or other
  misc_feature (249)..(249): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
  modified_base (591)..(591): a, c, t, g, unknown or other
  misc_feature (591)..(591): n is a, c, g, or t
  modified_base (646)..(646): a, c, t, g, unknown or other
  misc_feature (646)..(646): n is a, c, g, or t
tcagtcgtcgctcgcacgaccggtgctcgatttagactcatctacagggaaaggggtaggggtaccggaggagggcgagaactacgtgggtggtcgtcaccatggcctggactcctctacttcctccctccctctactctctgcacagctctgnggcctcctatgagctgacacacgcccaccctcggtgtcagtcgtccccgaggacacggacggcccgagggtactacctacccgtgccgtctcggnaaccggatcggtacgcgacctaaaaggaaaatattacggcttttaattcggaaacctaaaccgaggaaaggcccaacggaccgacggtccccttaggttccggtttaaagcggtaaactaagtaaacttaaaacggaacctacggtaaggtaccggaacggtccccgttaccgaaaggaacgttacctaccccggtcggaaggaccggttattttaccgngtttcccggggctacccggtaanccggttacgacggggtaacaggtccaacggtctaacgggttcacgtacgtactaagtcggtaaaccgtcgaccggaacgtaggacgggagaaccgggtncgttaacgtatacgtacggtaacaacgtaaggaacgtagaagtagacgtaacgtntacggtgggtagtcgggtacgggaacggtcgtagtacggtcgaaccggtcgtacgttacggacccgcgttaaccgggaccttccgggtaccccctcgg

SEQ ID NO: 201012 - DNA, 656 bp, Homo sapiens
  misc_feature: GYAE6OF01CCXAF.21.46.E02.1.454.CMB.1.raw
  modified_base (264)..(264): a, c, t, g, unknown or other
  misc_feature (264)..(264): n is a, c, g, or t
  modified_base (337)..(337): a, c, t, g, unknown or other
  misc_feature (337)..(337): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgtacttattacggaaccaanagaacgcgaggaccgacgtccctgtgttagtagaattaataaataaagacctacgaggaagtaccggccctanaagacgacttcccgagacgtcgtaactttcgacgttcggaccttccgagccgtacggagggacagccgtagtacgtacgtttacgaactagacgtaaggtacgaacgtaccgaaggacgaagggacggtaagacgggtactaacggtacttaacgttaacgtagtaaacgaaacgtaagtacgtaaacgaggtttacggaacgtttagtacgtaggttaggggtcgttacggggacggtaacgggacccgaaaggtcctacgggtacccgtactaggtaccgacgacccggaggtcccgttacccgcccccgtttaacg

SEQ ID NO: 201013 - DNA, 835 bp, Homo sapiens
  misc_feature: GYAE6OF01D7MT7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctggtgtcagtcgtcccaggacagacggccaggatcactgctctgcagatggactgaccaaagaatatgactttaagttcggtaaccaaacgaggaacgccgacggccacggtcccctggttgttagtagaattataaagtaaaagacacgtaggaacgacggacccctagagtagactacccgtaggacgtcgtactttccgtcgtcgggtcctaccgacgtcctacggaacggggacacggtacgtaacggttaccgtaacggtttacggtaacttacgttaccgtaagggttaacggtaaacggtacccgaaacgggaccggaaggggaacgggtaacgggacgggtacgttaacggtaaacgttaacgtttaacggtaacgttaaaccgtaaaaacggtaacggttaaacggaaacggtaaacgggtaaacggttaaacgggtttaaccgttaaccggttaaggggtttaacgggggtttacggggttaacccgggggtaccggggtaaaccgggggtaaacccggttaaacgggtacccggttaccggggttaaaccccgggttacccgggttaaacgggtaccccggtaaaccgggtaaccccgggtaaaccgggttccccggtaacccccgggttcccccccggttaacccgggg

SEQ ID NO: 201014 - DNA, 502 bp, Homo sapiens
  misc_feature: GYAE6OF01B3JBM.21.46.E02.1.454.CMB.1.raw
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcgagagatccctgagcgattctctggctccagctcagggacagcagtcacgttgactatcagtgaagtccaggcagaggacgaggctgactattacgtgtcaaangtaagacgagtagaggttactcgattgggtgttggcggaggacgagcgtgaccgtcctaggtcgacgaccaggcctcgccccgtcgg

SEQ ID NO: 201015 - DNA, 813 bp, Homo sapiens
  misc_feature: GYAE6OF01A3P2H.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgcccaccctcggtgtcagtcgtccccgaggaccagaccggccaggactccacctgctctgcagatggactagaccaaaagaaatagtgtacttagttacggtaaccaaacgaaggaacgacccgacgggacccacgggtccccttaggttacggtttacgtagtaattaacgtaaacgtaaaacggacctaacgtaggaacggaccggtcccctagaaggaacgtacctcccgtaggaccgtacgttactttccgtacgttcggcctaccgacgtaccgtacggaacgggacacggtacgtaacggttaccgtaacggtttacgtaaccgttagtaccgtaaggttacggaaacggttcccggaacgggtaacggaagggaacggggaaccggtacgggtaccgttaaggtaaccctttaacgtttacggttaagtaaccgtaaaacgtacggtaacgggaacgtaagggtaacggttaacgggttaaccgttaacgttacgggttacggggttcgggttaccgggggaacgggtaaccggggttaacccgaaggttacccggacgggttaccccggttacggttaaccggtaccggaccccggtaaccgggtaaccggtcccgtccccggttaccccccggtccgg

SEQ ID NO: 201016 - DNA, 515 bp, Homo sapiens
  misc_feature: GYAE6OF01ASR24.21.46.E02.1.454.CMB.1.raw
  modified_base (286)..(286): a, c, t, g, unknown or other
  misc_feature (286)..(286): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaaagaatatgcttattggtaccaacagaagccaggccaggcccctggtgttagngatataataaagacatgagacggccctgagacgatcccgtaggagccgtattcctctggcctccagctcgagggacagcagtcgacgttgactatcagtgaagtccgaggacaggacggacgaggctgactattacgtgtacaanagtaanacgtaagtagagtactcagtggtgtcggngaggacagcncggaccgtcgtaggcgacgaccaaggcctcgccccgtcg

SEQ ID NO: 201017 - DNA, 605 bp, Homo sapiens
  misc_feature: GYAE6OF01AIN7O.21.46.E02.1.454.CMB.1.raw
  modified_base (411)..(411): a, c, t, g, unknown or other
  misc_feature (411)..(411): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgtactttattacggtaaccaacgagaacgccaggcccacggcccctggtgttagtgtatataataaacgacacgtggaagacggccctacgagagtactcccgtagacgcgtacttctcgtcggcctcgacgctacgaggacacgactacgtactacgttagactanctagtagacgtcgaggacaggaggacgaggtctagtacttagttactagtaaccaaacgtagtaagacgtaaggtacgtagtacttagtaggttgggttcggtcgggacgggtaacggaaccgtaggtccgtacggtccggttaccgtaggaccgtaccggacccgaacggtcccgtcccgtcccccgttacgg

SEQ ID NO: 201018 - DNA, 588 bp, Homo sapiens
  misc_feature: GYAE6OF01BEVLA.21.46.E02.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccacggcccctgtgttagtgatatataaagacactgagacggccctanagagactccctgagcgtattctctggcctcgagctcgacgggacagcgagtcctacgttgaacttagtacgagtagaacgtcgaaggacaaggaggacgaggctagtacttattacgtagtaacaacgtagtaagacgtaaggtagtacggttactcgtagtttcgggtagttccgggagggaacgggtaccgtaacggtcgttaccggtaccgttacccgtagggtaccaccggtacccgaagggtcccttacccggcccccgttacccgg

SEQ ID NO: 201019 - DNA, 640 bp, Homo sapiens
  misc_feature: GYAE6OF01C20J5.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacggccaggatcacctgctctgcagatggactgaccaaaagaatntgacttatcggtaacaacagaacgaccaggccacggccctggtcgttagtgtataataataaacgacactaggacgacgcctacagtacgtactccgtagacgcgtacttctcgtcggcctccgagtcctacggaacgggtacaggtcgtaacgttccgtacggttactaacttacgacgtagtacggaaccggttacgacggtaacggaagaagggacggacggtacacgtaacgttacttacgtacgtaacctaaacgtagtaacgaacgtaaggtagtagttacctaggttagttgggtcggttacgggacgggaacggaccgtaagtcgtacggtaaccgttacggtacggtaacaccggacccggaaggtcccgtcccggtccccgttaccgg

SEQ ID NO: 201020 - DNA, 810 bp, Homo sapiens
  misc_feature: GYAE6OF01DTPS6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtcccaggacagacggccaggatcacctgctctgcagatggactgaaccaaaagaatatgtactttagttacggtaaccaaacgaagaaacgccgacgggccaacggtcccccttggttcggtttaagtgtaaattagttaaagtaaaacgtaaccaacgtacggaacggacggccccttacgaagacgtaacttccccgtaggacgtccgtatttccgttcgtcgggcccttaccgacgtccgtacggaacggggtacacggacgtacgttaccgtaacggttcgtaaccttacgtacgtaaggttacggaaacggttaccggaacgggaccggaagggaacggggtaacgggaacgggttacgtacggtaacctttaacgtttacgttaacggtaaaccgtaaacggtaacggttaacggaacggttaacgggtaacgggttaacggtttaaccgttacggttagggtttacgggggttaccgggttacggggaaccggggttaacggggtaaaccgtaacgggtacccggttaacggtacccggttaacccgggtaagggtacccgtaacccgggaaccccggtaaggttcccccgtacccggttccccccggttaccccggg

SEQ ID NO: 201021 - DNA, 509 bp, Homo sapiens
  misc_feature: GYAE6OF01A754I.21.46.E02.1.454.CMB.1.raw
  modified_base (242)..(242): a, c, t, g, unknown or other
  misc_feature (242)..(242): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgccaaaagaaatntgacttattggtaccaacagaagccaggccaggcccctgtgtagtgatataataaagacactgagaggccctacagagatcccctgagcgattctctggctccagctcgagggacagcagtcacgttgactatcagtagaagtccgagcgagaggacgaggctagactattactgtacaanagtagactagtagagtactcagttgggtgtcggcggaggaccagcctagccgtccgtaggtcgacgcccgaagctcgccccgtcgg

SEQ ID NO: 201022 - DNA, 546 bp, Homo sapiens
  misc_feature: GYAE6OF01E546Y.21.46.E02.1.454.CMB.1.raw
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgtacttattggtaccaaacagaagccaggccaggccccctgtgttagtgatatataaagacactgagacgccctcagagactcctgacgcgtattctctggccttccagctacgagggacagcagtcacgttgactagtcagtagaacgtccaggcaggacggagaggctagtacttagttactcgtaacaaacgngtaacgacgaggtagtaaggtactgtaggttgggtcggtcggacgggacgggaccgagctacggtcccgtcggtagccacgacccgaaggcctaccgccccgtaccgg

SEQ ID NO: 201023 - DNA, 685 bp, Homo sapiens
  misc_feature: GYAE6OF01EJQW7.21.46.E02.1.454.CMB.1.raw
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacagcccacccgtcggtgtcagtcgtccccaggacagacggccaggatcacctgctctgcagatggactgaccaaagaatatgtcttagttacggtaaccaacgagaacgccgaggccaggccccttgtgttagtgatataataaagcacgtgagcgcctagagagactccgngacgcgtattcnctcggcctacgagctacgacgggacacgactacgtacgtacggtttacgaacttacgttacgtaaggtacggtaacgtaccggaagggaccgaagggtaacggaaccgggtaggtaccgtacgttaacgttaacgtttacgtaacgtaacccgtaaaagtacggtaaacgaacgttaagggtaaggtaacgggttctacggttaggtttacggggtacggtttaccggggaccgggtaaacgggttaccgaacggttacgttaccgggtaaccccgttcggttaaccggaccgaccggtacccggtaacggtcccgttcccggtacccccgttaccgg

SEQ ID NO: 201024 - DNA, 561 bp, Homo sapiens
  misc_feature: GYAE6OF01A52R2.21.46.E02.1.454.CMB.1.raw
  modified_base (320)..(320): a, c, t, g, unknown or other
  misc_feature (320)..(320): n is a, c, g, or t
  modified_base (375)..(375): a, c, t, g, unknown or other
  misc_feature (375)..(375): n is a, c, g, or t
  modified_base (394)..(394): a, c, t, g, unknown or other
  misc_feature (394)..(394): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaatatgacttattggtaccaacagaagccaggccaggcccctgtgttagtgatataataaagactacgtgagacggccctanagagactccctgagcgattctcgtcggctccagctcgagggacagcagtcagttnactatcagtgaagtcaggnaaggaggacgaggctagacttattacgtagtaaccaaacgtagtaacacgtaggtaagtacggtactacgtagttggggtccggttaggaccgggaaggtaacccgaggtcgttacggacccgtcggtagacgtacggaccaagggtcctcccgggccccttaccgg

SEQ ID NO: 201025 - DNA, 563 bp, Homo sapiens
  misc_feature: GYAE6OF01EFXEK.21.46.E02.1.454.CMB.1.raw
  modified_base (319)..(319): a, c, t, g, unknown or other
  misc_feature (319)..(319): n is a, c, g, or t
  modified_base (380)..(380): a, c, t, g, unknown or other
  misc_feature (380)..(380): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgtacttattggtaaccaacagaagccaggccaggcccctgtgttagtgatatataaagacactgagacggccctnagagactcccctgagcgtaattcctcgtcggcctccagctcgagggacagcagtcacgttnactatcagtgaagtcgaggcaggaggacgaggctagtactattactagtaacaaagagtaagactaggtaagacggttactcgtaggttcggggtgttccgggacgggaacgggaccaaggtcgtacggtacccgtccgtaggtaccgacggaccccgaagggtcctccggcccccgttccgg

SEQ ID NO: 201026 - DNA, 610 bp, Homo sapiens
  misc_feature: GYAE6OF01E1DAB.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgattttagactcatctacagggaaagggggtggggtccaggaggcagaactctgggtgtctcgaccatggcctggatccctctacttctccccctcctcactctctgcacaggctctgaggcctctatgagctgacacagccaccctcggtgtcagtgtccccaggacagacggccgaggatcgacctgctcgtgcagatggactgccaaagaatatgcttatggtaccaacagaagccaggccaggcccctgtgttagtgactaatataaagacacgtagagaggccctnaggagatccctgacgcgtattctctggtctccagtctacgagggtacaggcacgtcgtaacgttcgtactactcaagtgaacgtcgaggacaggaggacgaggctagtacttattactagtacaaacgtacgtaagacgtagtaaggaaggttactacgtaggtttggggtacgttacggggaccgggtaacggggaccgtaaagggtccgtacgggtaacccggtccggtaaggtaccgtaaccggtaccccgtaaagggtccccgttacccggccccccggttaccggg

SEQ ID NO: 201027 - DNA, 524 bp, Homo sapiens
  misc_feature: GYAE6OF01AG0UD.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggcccctgtgttagtgatataataaagacactgagaggccctnagagactcccgtgagcgattctctggctccagctcgagggacagcagtcacgttgactatcagtagaacgtcgaggcaggaggacgaggctagactattactgtacaacagtagacgagtagaggtactcgtagttgggtgttcggacggaggaccgtaagctggtacccgtacgtaggtcgacgaccgaaggcctcgcccccgtacgg

SEQ ID NO: 201028 - DNA, 649 bp, Homo sapiens
  misc_feature: GYAE6OF01D8Y3J.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccgggacaaacggccaggatcacctgctctggagatgcattgacctaaaaaattnttgttttttggaccagcagaagtcaggaccaggcccctgtgttagtgatataataaagacactgagacggccctacgagagactccctagagcgtaattctcgtgcctccagcctcgacgggacacgacagtcacgtttgacttatcgagtagaagtccaagggtcaagggacggaacggaggaccttaggaactttaagttaccttaggtaaccaaacgaacgttaagaacgtaaggttaacggaagttaactacgtaggttttcggggttcggttacgggacggggtaacgggaccaaggtcccgtacggtacccggttacggttacggaccgtaaccggaccccgtaagggcccgttacccggtcccccggttacggtacccgtccgttcccgtttcccccggg

SEQ ID NO: 201029 - DNA, 759 bp, Homo sapiens
  misc_feature: GYAE6OF01D8PVZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctcctatgagctgacacacgcccaccctcggtgtcagtcgtccccaggacaggaccggccaggatccacctgctctgcagatggactgaaccaaaagtaatatgtctttaagttacggtaaccaaacgaagaacgccaaggacccaacggtcccctaggttcgttaagtcgaattaagtaaactaaaacggacctacgtaggaacggacggtaccccttagaaggacgtacctccccgtaggaacgtcgtactttcgtcgtacggtccttaccgaacgtccgtaccgaagggaccacgggtacctaacggttacccgtaacggtttaccgtaacgtttaacgtacccgttaagggtaagtaaaccggttcccgaagggaccgtaagggaacgggtaacgagggttactacggtaacttaacgtttcgtaacgtaacaaacgtagttaacgaaccgtaggtaacggttaacgtactacggttaaggtttcggggtacggttaccggggacgggttaacgggaacccgtaacggttaccgttaccgggtacccggtaccgtaaggtacccgaaccggtacccggaacggtccccgtacccgtcccccggttaccgg

SEQ ID NO: 201030 - DNA, 544 bp, Homo sapiens
  misc_feature: GYAE6OF01C71SA.21.46.E02.1.454.CMB.1.raw
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctcggtgtcagtgtccccaggacagacggccaggatcacctgctctgcagatggactgaccaaagaaatntgctttattggtaccaacagaagccaggccaggcccctgtcgttagtgatataanaaagacactgagaggccctnagagactccctgagcgtattctctggcctcagctcgagggacagcagtcacgttnactntcagtgacgtcgaggcaaggaggacgaggctagacttattacgtgtaacaaacgtagtagaacgtaggtagaggtactacgtagttgggtcgttcgggacgggagggaccaaggcgtacggccgtacgtaggtaccacggacccgaggaccgtccgccccgttaccgg

SEQ ID NO: 201031 - DNA, 678 bp, Homo sapiens
  misc_feature: GYAE6OF01BXNPC.21.46.E02.1.454.CMB.1.raw
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctggtgtcagtgtccccaggacagacggccaggatccacctgctctgcagatggactgacaaaagaaatatgtacttattcggtaaccaagagaacgccaggccacggcccctgtgtagngatanaataagacagtgacggacgccctgagagactcccgtagacgtaccgtatttccgtacgtcgggtcctaccgacgtcgtacggaacggggactacggacgtaacggtcctaacggtttacgaacttacgtactaacgggtagaaacggttccgaacgggacgaagggaacgggaacgtacggtacgtaacgtaacgtttaacgttaaccgttagtaaaccaaacggtaggtaacgtaacgtaagggtttaacggaacgtttacgtaacgttaggtttcggggttaggttaccggggaccgggtaaggaaccgaacggtccgtacggtcccgaccggttaggacccgtacgacccgtacggtccctacccggccccgtaccgg

SEQ ID NO: 201032 - DNA, 567 bp, Homo sapiens
  misc_feature: GYAE6OF01A7SQG.21.46.E02.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacgagaagccaggccacggcccctgtgttagtgatataataaagacactgagacggccctnagagactccctgacgcgtattccgtctcggcctcagctacgacggacagcgagtcacgttgactatcgagtgaacgtccgaggacaggaggacgaggctgacttattacgtcgtaacaaacgtagtaagaacgtaggtagtaggttactagtagttcggggtggttacgggcgggtaacgggaccaaggtctacggtacccgttcgtacggtacgtacggacccgaaggcccgtcccgcccccgttcgg

SEQ ID NO: 201033 - DNA, 555 bp, Homo sapiens
  misc_feature: GYAE6OF01BCWDD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattacggtaaccaaacagaagccaggccacggcccctgtgttagtgatatataaagacactgagagccctgagagactccctagacgcgtatttcctcgtcggcctccgacgtctacgaacgggacagcagtcgacgttacgactatcgagtagaacgtcgaggacaggaggacgaggtctagtactattacgtagtacaagagtagacgaggtagtagtactagtagttgggtgtacggacggagggaaccgagtcgtacggtcccgtacgtaggtcgacggccgaaggcctccggtcccccgtcgg

SEQ ID NO: 201034 - DNA, 614 bp, Homo sapiens
  misc_feature: GYAE6OF01D4GHY.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctgcagatggactgaccaaagaaatntgacttattggtaaccaacagaagccgaggccacggcccctgtgttagtgatataataaagacacgtagacgacggccctcagagactcccgtgacgcgtattcctacgtcgcctccagcgtacgagggacagctagtcacgttgactatcaaggtgaacgtccgaggcaaggaggacgaggctaggacttagttctacgtacgaaactagtagaaccgtaggtaagtacggttactacgtaggtttgggtacggttaccggggacgggtaacgggaccgtaaggtcccgttacgggtaccccgttacggtacgggttacccgacgggtaccccgaacgggtcccttccccggtccccccggttacccgg

SEQ ID NO: 201035 - DNA, 523 bp, Homo sapiens
  misc_feature: GYAE6OF01EIASJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatccctgagcgattctctggctccagctcagggacagcagtcacgttgactatcagtgaagtcaggcagaggacgagctgactattactagtacaaacgagtaagacgagtagaggtactgagttgggtagttcgggcgggagggaccgaaggtcgtaggacccgtacgtaggtacacgacccgaaggcctcggcccccgtacgg

SEQ ID NO: 201036 - DNA, 664 bp, Homo sapiens
  misc_feature: GYAE6OF01DR1UV.21.46.E02.1.454.CMB.1.raw
  modified_base (323)..(323): a, c, t, g, unknown or other
  misc_feature (323)..(323): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatcacctgctctgcagatggactgaccaaagaatatgacttagttggtaaccaacagaacgccgaggccacggcccctgtcgttagtgatataataaagacactgagacgcctanagagtactcccgtgagcgtacttctacgtggctaccgagaccgtcgaacgggaccaggacctaggttacctaacggtttagaaccttaagtaccgtaagggtacggtaaaccgtcccgaagggaccaagggacgggaaccggtagggtcttacgaaacctttaagtttaaccgtacggttaaccaaacgtaaggttaacgaacgtaagggttacgtaacggttacttacggtagttcggggttacgttcggggacgggtaacgggaccgtaaggtacgtacggtacccgtacgttaccggacgaccggtaccgaaggtcccttacccggccccgttaccgg

SEQ ID NO: 201037 - DNA, 246 bp, Homo sapiens
  misc_feature: GYAE6OF01CHDBO.21.46.E02.1.454.CMB.1.raw
  modified_base (236)..(236): a, c, t, g, unknown or other
  misc_feature (236)..(236): n is a, c, g, or t
  modified_base (242)..(246): a, c, t, g, unknown or other
  misc_feature (242)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggcctgggctgcctggtcaaggactacttccctcgtctctactgagcgggctggcaaggcncatagnnnnn

SEQ ID NO: 201038 - DNA, 780 bp, Homo sapiens
  misc_feature: GYAE6OF01BFG63.21.46.E02.1.454.CMB.1.raw
tcagtcgtcgctcgcacgaccggtgctcgatttagactcatctacaggggaaaggggtgggtccgaggaggcgaggaactcgtgggtgtctcgaaccatggcctggatccctcgtaccttcctccccctcctccacctcctctgtcacgacggctctgacggtcctccgtatcgagtcgtggacacacgcccacccgtcggtcgtcgagtcgtccccgaggaccaggaccggaccgaggactccacctcgctctgcgagatggactacggaaccaaaagtaatagtacgtacgttagtacgaacgtaacgaagaacgcgacggaccgacggtccccgtgtacgtagtacgtactactaagtaacgacgacgtaggacgtacggaccctacgacgacgtactaccgtggacgtacgtacgttcgtccgtcggtccgtaccgacggtaccgtacggaacgggaccgtaacggtccgtaacggttaccgtaacggttacgtaacgttacggtacggtaacggtacgggtaacgtaccggtaagggacgaacgggtaacgggtaaccggtaacgggtaccgttaacgtaaccgttacgttaacgtaacgtaaccgtaaacgaggtaacgtacgtaagggtaacggttaacgggttactacgggtacggttacggggtacggtcggggaccgggtaacgggtaaccgtacggtaccgtaccggtaccgtaccggtacggaccgtacccggacccggtacggtcccgtcccggtccccggtcccgg

SEQ ID NO: 201039 - DNA, 692 bp, Homo sapiens
  misc_feature: GYAE6OF01DAWMW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgtactttaattcggtaaccaacgaagaacgccacggaccacggcccccttggtagttagtagaatataataaagacacgtagagacggccctagaagacgtataccccgtgagcgtatttcgtcgtacggctccgaagcctacgaacggggacaggtacaacggtcgtacggttacgaacttaacgtcgaaggttacggaaacgtccccggaaagggaccgaaagggaacgggaaccggtagggtacgttaacgggtaactttaacgtttaaccgttacggtaaacctaaaacgtaacggtaacggtaaaccgtaagggttaacggaacgggtttactacgttagggtttcggggttacggttacgggaccgggtaaacgggacctaggtaccgtacggtaccgtccgtaggactacgacccgtaaggcctcccggccccgttaccgg

SEQ ID NO: 201040 - DNA, 589 bp, Homo sapiens
  misc_feature: GYAE6OF01DEAQR.21.46.E02.1.454.CMB.1.raw
  modified_base (244)..(244): a, c, t, g, unknown or other
  misc_feature (244)..(244): n is a, c, g, or t
  modified_base (324)..(324): a, c, t, g, unknown or other
  misc_feature (324)..(324): n is a, c, g, or t
  modified_base (453)..(453): a, c, t, g, unknown or other
  misc_feature (453)..(453): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatntgactttattggtaaccaacagaacgccaggaccaggcccctgtgttagtgaatataataaagacactagagaggccctnagagactccctagacgcgattcctcgtggcctccgagtctacgagggacagcgagtcgacgttgactatcgagtagaacgtcgaggacaggaggacgaggctagacttattactagtacaaagagtaanaacgtagtagagtacgtactaggttgggttacggttccgggagggtaacggaccgtaaggtccgttacggtaccccgtaccggtacggtacgtaaccggtacccgaacggtcccgtcccggtccccccgttaccgg

SEQ ID NO: 201041 - DNA, 646 bp, Homo sapiens
  misc_feature: GYAE6OF01DEVDR.21.46.E02.1.454.CMB.1.raw
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (339)..(339): a, c, t, g, unknown or other
  misc_feature (339)..(339): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtacaacagaagcaggccaggcccctgtgttagtgatataataaagacactgagagcctnaganatcctgagcgattctctggctcganctcgagggacagcgtagtcgacgttaggacttagtctaagtacgaaggttacccgagggtacaaggaacgggaacgagggaccttaggaactttagtttaaccgtagtaacctaaaacgtaagttaacgaaccgtaaggttaaggaacggttaacttaccgtaaggtttcggggttacggttttccggggacggggtaacggggaacccgtaaagggtccgttacgggtaaccccggttacccgttaacgggtaccgtaacggtaccccggaagggtcccgtaccggtcccccccggtttacccggg

SEQ ID NO: 201042 - DNA, 556 bp, Homo sapiens
  misc_feature: GYAE6OF01ET316.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtgtccccaggacagacggccaggatcacctgctctgcagatggactgaccaaaagaatntgcttatgtacaacagagcagccaggcccctgtgtagtgatataataaagacactagagacggcctacagagactcctgagcgattctacgtcggctcacgctcagggacagcagtcacgttgacttatcgagtgaacgtcgaggacaggaggacgaggtctagactattacgtcgtacaaacgtgtaacgaacgagtaagacgtactcgtaagttgggtcggttacgggacgggtaagggtaccgaaggtcgtacggtacccggtccgttaggaccgaaccggacccgaaaggccgtcccggcccccgttacgg

SEQ ID NO: 201043 - DNA, 547 bp, Homo sapiens
  misc_feature: GYAE6OF01DDUDI.21.46.E02.1.454.CMB.1.raw
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
  modified_base (425)..(425): a, c, t, g, unknown or other
  misc_feature (425)..(425): n is a, c, g, or t
  modified_base (527)..(527): a, c, t, g, unknown or other
  misc_feature (527)..(527): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttaattggtaaccaacagaagccaggccaggccccctgtcgttagtgatataataaagacactagagaggccctnagagatccctgagcgattctctggctccaagctcaggacagcagtcacgttgaactatcagtagaacgtcaggacagaggacgaggtctgacttatactgtacaanagtagagagtagagtactatagttgggtagttcgggaggagggaacccaaaggtcgtacggtacccgtaccgtacggtacgaccgtacccgaacggttaccnccggtcccccggttacccgg

SEQ ID NO: 201044 - DNA, 742 bp, Homo sapiens
  misc_feature: GYAE6OF01C3VKK.21.46.E02.1.454.CMB.1.raw
  modified_base (133)..(133): a, c, t, g, unknown or other
  misc_feature (133)..(133): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcanaggctctgaggcctcctatgagctgacacagcccaccctcggtgtcagtcgtccccaggaccaggaccggccaggactcacctgctctgacagatggactggaccaaaagaatatcgtactttagttacggtaaccaacgaagaaacgcgacggacccgacggccccttaggtacgttagtagtaattataaacgtaaagactacgtacggaagaccggtccctagaacggacgtaccttccgtagacgcgtacgtttccacgtcggaccttaccgagttaccaggaacggggacacggactacggtacgtacggttacgaacttacgtacgaaggtacgaaacggtccgaagggacgaagggaaccggtacggaggtaccgttacgaagtttaacttttaccgtaacgtaaccgaaaacgttaggtaaacgtaccgtaaagttaacgggtaacggttacttacggtaagggtttcggggttacggaccggggtacgggtaaaggaaacccgtaagggttcgttaaacccggtccgggttaaccggttacgggaccctaacccgggacccgttaaccggtccccggttacccgggcccccgtttaccgg

SEQ ID NO: 201045 - DNA, 711 bp, Homo sapiens
  misc_feature: GYAE6OF01AE3A0.21.46.E02.1.454.CMB.1.raw
  modified_base (327)..(327): a, c, t, g, unknown or other
  misc_feature (327)..(327): n is a, c, g, or t
  modified_base (397)..(397): a, c, t, g, unknown or other
  misc_feature (397)..(397): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatccacctgctctgcagatggactgaccaaaagaatatgacttattcggtaaccaacagaagccgaggccacggtcccctggtcgttagtgatataataaagacactgaagacggccctanagagactccgtagacgcgtattctcgtcggctccgagcctacgacgggacagacgtacgtactacgttanaccttataccgtaaggtacggaacggttacccgaagggacgaacgggaacggacgggaacgggtacttacggtaacttaacgtttaccgtacgtaaccgaaaacgtaggtaaacgtaacggtaaggttaagtaaacgggttacttacggtacgggttttgggggttacgggtttacccggggaccggggaacggggtaaacccgtaacgggtaccgttaccggggaaaccccggtttaccgggtaaccgggttaccggaccgggtaaccccggaaaccgggtcccgttccccgggcccccccgtttacccgggg

SEQ ID NO: 201046 - DNA, 795 bp, Homo sapiens
  misc_feature: GYAE6OF01DJ9TI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctgcagatggactgaccaaaagaaatatgtacttagttggtaacccaacgagaacgccaggaccaacggccccctgtagttagtgatataataaagactacgtagagacggccctagaagagacctcccagacgcgtaatttccgtcgtcggacctccgacgtccgtaccggaacggggaaccgaggaccgtaacggttaccgtaaccgtttacgtaaaccgttaacgttaccgtaaggttaacggtaaaacgggttcccgaaagggtaccggaaagggaacggggtaaccgggtaacgggtaccgttaacggtaacctttaacttaaccggttaacgtaacctaaaacgtaaggttaacggaaacgtaaacgggtttaagggtaacggttaaccgttacggtaaggttttcgggggttaaccggttacggggtaacccgggggtaaacgggaaaccccggtaaagggtacccgttaacgggttaaacccccggttaccggtttaccggaaccgtaacccgggtaacccccggtaaacggggtccccgttccccgggaccccccggtttaaccccggg

SEQ ID NO: 201047 - DNA, 594 bp, Homo sapiens
  misc_feature: GYAE6OF01ET47Z.21.46.E02.1.454.CMB.1.raw
  modified_base (291)..(291): a, c, t, g, unknown or other
  misc_feature (291)..(291): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtcttattggtaaccaacagaagccaggccacggcccctgtgttagtnatataataaagacatgagacggcctacagagactcccgtagacgcgtattctcgtcggcctcgacgcctacgagggacagtcagtacgacgttacgactatcgagtagaacgtccgaggacaaggacgggacgaggctaggtacttacttacgtacgtaacaaacgtaggtaagacgtaaggtagtaacgttactacgtagttggggtacggttacgggacgggaacgggacgaaggtcgtacgacccggttaccgtaggtaccgaccggtacccgaggtcccgtcccggtcccccgtaccgg

SEQ ID NO: 201048 - DNA, 631 bp, Homo sapiens
  misc_feature: GYAE6OF01A3MA1.21.46.E02.1.454.CMB.1.raw
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
tcagtcgtcgctcgcacgaccggtgctcgatttagactcatctacagggaaagggggtggggtccaggaggcagaactctgggtgtctcaccatggcctggatccctctacttctcccctcctcactctctgcacaggctctgaggcctcctatgagctgacacacgccaccctcggtgtcagtcgtcccaggacagacgcaggatcactgctctgcagagtggactcgaaccaaagaatatgcttattacgtaaccaanagaacgccgaggccacggcctggtgttagngataataataaagacatagagaccggcctacgaagacgactccgtagagctagttcacgtgacctcacgcgtcgaaggacagactagtcgacgtttgacttactacgagacggtactaccggagacgaggaggaccgtaggccttacgtaacgttaacgttactacgtaaacgtaaacgtataacggtacgaaggttaaacggtaacggttactttaccgggtaaggtttggggttaaccgggtacgggaccggggtaacggaacccggaagtccgtaccggttacggttacccgtaggaccgaccggacccggtaggtacccgtcccggtaccccgttcg

SEQ ID NO: 201049 - DNA, 697 bp, Homo sapiens
  misc_feature: GYAE6OF01CYUKY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatcggactgaccaaaagaaatatgtacttattcggtaaccaacgagaacgccgaggccacggccccttgtggttagtagtaataataataaacgacacgtaggacggacggtcccctacaggacgtactccccgtaggacgtcgtacgttcctcgtacggcctaccgacgtcctacgaacggggacagaccgtagtccgtacggttacgtaaccttagtaccgaggtacgacggttacccgaggtacgaaggacgggacgaggtctacgtaacttagtttacgtacgtacgaaacgtagtaacggaacgtagggtaagtacggttacttaggttaggttacggggttagttaccgggggaccgggaagggaaccggtaacggtccggttaaccggtaccccggttaccggttacgggtcccgaaacccgggacccgtaacgggccccgttccccggtcccccggttacccggg

SEQ ID NO: 201050 - DNA, 531 bp, Homo sapiens
  misc_feature: GYAE6OF01B1R2Z.21.46.E02.1.454.CMB.1.raw
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtcgttagtgatatataaagacactgagaggccctanagagactccctgagcgtattctctggctccagctcgagggacagcagtcagttgactatcagtgaagtccaggcaggaggacgaggctagactattactgtacaacagtaagacgagtaagaggttactacgtagttgggtggttacgggcggaagggaccgaaggtgtacggaccgtaccgtaggtcacgccgaaggctcccgccccgttaccgg

SEQ ID NO: 201051 - DNA, 537 bp, Homo sapiens
  misc_feature: GYAE6OF01EVA71.21.46.E02.1.454.CMB.1.raw
  modified_base (258)..(258): a, c, t, g, unknown or other
  misc_feature (258)..(258): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacggccaggatcacctgctctgcagatggactgaccaaagaatatgctttattggtaaccaanagaagcaggccaggcccctgtgttagtgatatataaagacactgagaggccctgagagactcccgtgagcgattctcgtggctccagctacgacgggacacgcacgtcacgttgactactcgagtgaacgtcgaggacgaaggaggacgagtctagtactacttacgtgaacaagagtagaacgagtagacgtatacgtagttggtgtacggcggacggacgagacgtacggtacccgtcgtagacgaccgcccgtaaaggcctccggtccccgtaccg

SEQ ID NO: 201052 - DNA, 529 bp, Homo sapiens
  misc_feature: GYAE6OF01CO6LA.21.46.E02.1.454.CMB.1.raw
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (367)..(367): a, c, t, g, unknown or other
  misc_feature (367)..(367): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
  modified_base (473)..(473): a, c, t, g, unknown or other
  misc_feature (473)..(473): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgcagatggactgaccaaagaaatntgcttattggtaaccaacagaacgccaggccaggcccctggtgttagngatataataaagacactagaggacggccctgagacgatcccgtgagcgtattctctggcctcagctcgagggcaggnacgtcagttgactatcagtgacgtccgaggcaggaaggacgaaggngtacgactattacngtacaaagngtaagagagtagagttactgagttgggtggttacggnggaagggaccgtagcgtcgaccggtcgtaggcacgccgaagcctcgccccgtccgg

SEQ ID NO: 201053 - DNA, 660 bp, Homo sapiens
  misc_feature: GYAE6OF01EMQQN.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacaggggaaagggggtgggtccaggaggcagaactctgggtgtctcaccatggcctggatcctctacttctcccctcctcactctctgcacgaggctcgtggaggcctcctatgagctgacacacgccacccgtcggtgtcagtcgtcccgaggacgaggaccggccaggactccacctgctctgcagagtgactgaccaaagaatntagtacttagtacggaacaacgagaacgccgacggccacggtccctgtgttacgtgtaataagtaacgtaaacgcctacgtacgacggacgccctacgaggtacgtacgtcccgtaggacgtcgtacttcgtacgtcggtcctacggacgtccgtacgacgggtaccaggtcctacgtccgtaacgtacgtactacgtcgaacgtcgtaacgtcgaacggcgaacggacgacgcgtactacggtacttacgtactacggtaaccaaacgtgtaacgagtacgtacggtagttacgtagttacggtttcgggtacggttccgggacgggtaacggtacgtaacggtcggttaccggtaccggtacggtagaccgtaccggtacccgaaggtcccgtcccgtcccgtaccgg

SEQ ID NO: 201054 - DNA, 847 bp, Homo sapiens
  misc_feature: GYAE6OF01DZZ60.21.46.E02.1.454.CMB.1.raw
  modified_base (176)..(176): a, c, t, g, unknown or other
  misc_feature (176)..(176): n is a, c, g, or t
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggntcagtcgtccccaggacagaccggccaggactcacctgcctntgcagatggactgaaccaaaagaaattntacgtacttagttacggtaaccaacgaagaacgaccgaacgggacccaaccggtccccgttggttacgttaaggtacggtaattaagttaaagttaaaaacgacgtaaccgttagggaacgtaccgggtccctacgaacgtaacgtacgtacccgtaggacgtacgttacgttcgtcgtacggtccctaaccggtacgtaccgtaacggacggggaaccacgggtaccgttaaaccggtacggtttaaccggttacgtaacggttaacttaccggtaaggttaaccggtaaacggttaccggaacgggaacggtaacggaaacgggacggtaacgggtcctaacgggttaacttacggtttaacgtaagtaaccaaacggttaagtaaccggtaaacgtaagggttaacggttaagttaccgttacggttaagggtttcggggttacggttaacccgggggacgggtaaaccgggtaaccgtaaacgggttacccgttaaccgggttaccccgggttaaccgggttaccggaaccggttaaacccggaaccccgggttaacgggtccccgtttacccccgggtcccccgggtttaacccgg

SEQ ID NO: 201055 - DNA, 640 bp, Homo sapiens
  misc_feature: GYAE6OF01ELB46.21.46.E02.1.454.CMB.1.raw
  modified_base (241)..(241): a, c, t, g, unknown or other
  misc_feature (241)..(241): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacggccaggatcacctgctctgcagatggactgaccaaagaatntgacttatcggaaccaacagacgccagccacggcctgtgtagnatatataaagcagtgagacgccctanagactactccgtagacgtcgtactttcgtacgtcggccttaccgagcctacggaacgggacacggctagttaccgtacgtttagaacgtactacgaaggtagaacgtacccgagggacgaagggaacggacggacgtacgtacggtaacttagttacgtacgtaacctaaaacgtggtaacgaacgtaaggtaacggtaacggttaacttcgtaagggtttcgggtacggttaccgggacggggtaaaggaccggtaacggcgtacggtacccggttccgtaacggaccgtaccggaacccgtaacggtcctcccggtcccccgttacgg

SEQ ID NO: 201056 - DNA, 524 bp, Homo sapiens
  misc_feature: GYAE6OF01BGTU9.21.46.E02.1.454.CMB.1.raw
  modified_base (258)..(258): a, c, t, g, unknown or other
  misc_feature (258)..(258): n is a, c, g, or t
  modified_base (315)..(315): a, c, t, g, unknown or other
  misc_feature (315)..(315): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
  modified_base (480)..(480): a, c, t, g, unknown or other
  misc_feature (480)..(480): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaanagaagccaggccaggcccctgtgttagtgataatataaagcactgagacggccctanagagactccctggaagcgtattccgtcgtcggcctccagctacgagggacagcagtcacgttgactatcgagtagagtcaggcagaggacgngctagactagttacagtacaacngtagacagtagaggtactgagttgggtcgttcggnggacggacgagtacncggaccgtcgtacggtcacgacccgaaggctcccgcccgtacgg

SEQ ID NO: 201057 - DNA, 748 bp, Homo sapiens
  misc_feature: GYAE6OF01DREKL.21.46.E02.1.454.CMB.1.raw
  modified_base (477)..(477): a, c, t, g, unknown or other
  misc_feature (477)..(477): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatggactgaccaaaagaatatcgtacttattacggtaaccaaacgaagaagaccgacggacccacggtcccccgttggttgttaggtaggtaattaagtaaacttaaaaggaacctacgtaggaacggtaccggaccccttacgaaggacgtaaccttaccccgttaggacggtaccgttaacgtttccgtaccgttcggtaccctaccgacgtccgtacggacgggaccagaccgtacgttactaccgttanaacgttactacgtaggtacggaaacgtcccggaaggacgtaggaagggacgacgggtacgttaagtaacttaagtttaccgtagttaaccgaaacgtagtaacgacgtaaggtagtaacgttactacggttacggtttaggggttacggttaccgggaccgggtaaggaaacccgtacggacccggttacggtaacccggtttccgtaaccggttccgaacccgggtaccccgaacgggttccccgtcccggtaccccccggttacccggg

SEQ ID NO: 201058 - DNA, 710 bp, Homo sapiens
  misc_feature: GYAE6OF01DUKBR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgccaccctggtgtcagtcgtcccaggacacgcggccaggatcacctgctctgcagatcggactgaaccaaaagaatagtgtactttagttacggtaaccaaacgaagaacgaccgacgggccgaacggcccctggttcgttaagtagtaattataaacttaaaaggaacacgttaggaacgacggtacccctagaacgaagtacgtaccccgtaggacgtaccggtaactttccgttcgttcgggtaccttacccgaacgtcccgttacggaacgggtacgacggaccgtacggttaccgtacggttacgtaacttaacgtaccgagttaacggaaccgttaccgaaggaccgaagggacgggaacggaaggtcgtacggtaacttagttaacgtattaaccgaaagtaacgtaagaacgtagtaacggtaagttctagttaggttgggtacggtcgggacgggtaacggaccggtaacgcgttacggacccgttcggtacggtaccgtacggaccgtaacgccgttacccggcccgttacccgg

SEQ ID NO: 201059 - DNA, 575 bp, Homo sapiens
  misc_feature: GYAE6OF01CKMKA.21.46.E02.1.454.CMB.1.raw
  modified_base (243)..(243): a, c, t, g, unknown or other
  misc_feature (243)..(243): n is a, c, g, or t
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctcggtgtcagtcgtccccaggacagacggccaggatcacctgctctgcagatggactgaccaaagaaatntgcttattggtaccaacagaagccaggccaggcccctgtgttagtgatatataaagacactgagacggcctacagagatcccctggagcgtattcctactggcctccagcctcgagggacagcgtagtcacgttgactatagagtagaagtccgaaggcaggaggacgaggtctagactattactagtacaaaagngtaagacaggtagaggtactagtagtttggggtgttcgggcgggaacgggtaccgtaaggttcggaacccgttccggttaaggtaccgaacggacccgtaaggacccgttcccggccccccgttcgggttaccccg

SEQ ID NO: 201060 - DNA, 598 bp, Homo sapiens
  misc_feature: GYAE6OF01DES4M.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacagccaccctcggtgtcagtcgtcccaggacagacggccaggatccacctgctctgcagatggactgaccaaagaaatntgacttaattggtaaccaacaagaaacgaccgaacggaccgaacggccccccttaggttaggtttagtggaattaataataaagacacgtagacgagccctacagagactaccctgagcgtattctctagcctccagtctacgagggacagcgtagtctacgttgaacttagctagtgaacgtcgagacaggagacgagctagacttagtacgtagtacaacgtaagagaagtaagtagacgttacttacgtaggtttaggtcggttacgggaccgggtaagggaccgaaaggtactaccggtaccgtaccgttaggaccgacggacccgaaggccctcccggtccccgttacccgg

SEQ ID NO: 201061 - DNA, 780 bp, Homo sapiens
  misc_feature: GYAE6OF01EPJPC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatccacctgctctgacagatggactcgaaccaaaagtaaatagtcgtactttaagttcggtaaccaaacaaggaacgccgaacggcccaaccggccccgttggttagtttacggtagtaattagtaaacgttaaaaacgacacgttacggaaggtaaccgggtcccctagaacggtacgtaccgttaccccgtaggaaccggtcgtaactttccgtcgtcgggccttaccgacgtaccgtacggaagggtaccacgacgtacgtccgtacggtttagaccttagtaccgtaggtacgtaacggtccgaagggacgaagggtaacggacgtacgggtactacggaactttaagttaccgtaacgtaacgtaaaacggagttaacggaacgttaacgggtaacggttaaacggttacctttaacggttaacggggtttacggggttacgggttaccggggtaacggggtaccgggaaaaccggtaacggtcggttaacccgtaccccgggttacgtaacggtacccggtaccggtacccggaaccgggttcccgtacccggtccccccggttaaccgg

SEQ ID NO: 201062 - DNA, 750 bp, Homo sapiens
  misc_feature: GYAE6OF01D9W2U.21.46.E02.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacacgccacccgtggtntcagtcgtacccaggacaggaccggccaggactccaccgtgctactgacagagttcggactcggaacctaaaagaattactagtactttaagttacggaaaccaaacgaagaacgtacccgaacggacccgtacggaccccgttggttagtttaaacggtcgtaaagttaataacgttaaacgaaccgtacgttaccggaaggacccggacccttagaacgtacgtaaccgttcccgtaggacgacgttactttccgtacgtccggtacaccgtagtccgtaacggacgggaactggtactaggttaccgtacgttgaactacgtagagtacggtaactcggaaagcgtaaggacggaaccgtggtacgtaacgtatttaacgtactacgggtaactaaacgtacggtaacggtagttaacgtaacgggtaacggtttacttaacgggttaaggttttccgggaagggtttaccgggacggggttaacggacccggttagggtaccgttaccggaccgtttacggaacggttccgtcgaaccggttaccgcgttcccgaaccccgtttcgg

SEQ ID NO: 201063 - DNA, 617 bp, Homo sapiens
  misc_feature: GYAE6OF01DOFGP.21.46.E02.1.454.CMB.1.raw
  modified_base (325)..(325): a, c, t, g, unknown or other
  misc_feature (325)..(325): n is a, c, g, or t
  modified_base (399)..(399): a, c, t, g, unknown or other
  misc_feature (399)..(399): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatccacctgctctgcagatggactgaccaaaagaaactatgactttatcggtaaccaacagaacgccaggaccaggcccctgtcgttagtgatataataaagacacgtgagacgcctanagatactccgtagacgcgtaatttccgtcgtcggcctcgacgctacggaagggacacggctagtcgtaacgttnaccttatacgtagtagtaacgtcccgaggtacgaaggaacggacggaggtcgtagtaacgtttacttaacgtataacgaaacgtaggtaacaacgtaaggtacgtaacggttactacgtaggttgggttcgtacgggcgggaacggaacgacggtcggacgtacccggtacgtaacgggtccaaccggaccgaaggtcccgtccgtcccccggtaccg

SEQ ID NO: 201064 - DNA, 649 bp, Homo sapiens
  misc_feature: GYAE6OF01EWVBW.21.46.E02.1.454.CMB.1.raw
  modified_base (333)..(333): a, c, t, g, unknown or other
  misc_feature (333)..(333): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcaggtcgtccccaggacagacggccaggatcacctgctctgcagatggactgaccaaaagaaatatgtctttattcggtaaccaacaagaacgccgaacggccgaacggccccctgtgttagtgatataataaagacactagagaggtccctanaggagactcccgtgacgcgtacttctcgtggcctccgagctcgagggtaccagccgagtcgtaacgttcgtaacttatacgtaggtagaaacgttccgaaggacaaggacggacgaggctagacttagttacgtacgtacaaacgtaggtaagacgaaggtacggtacggttactacgtagggtttcgggtacggtttccggggacgggtaacggggaacccgtaaggtccggttaccggtacccggttacccgttaacggggacccctacgggacccctaaacggggtccctcccggtccccccgttacccgggg

SEQ ID NO: 201065 - DNA, 553 bp, Homo sapiens
  misc_feature: GYAE6OF01BF1Y6.21.46.E02.1.454.CMB.1.raw
  modified_base (317)..(317): a, c, t, g, unknown or other
  misc_feature (317)..(317): n is a, c, g, or t
  modified_base (446)..(446): a, c, t, g, unknown or other
  misc_feature (446)..(446): n is a, c, g, or t
  modified_base (470)..(470): a, c, t, g, unknown or other
  misc_feature (470)..(470): n is a, c, g, or t
  modified_base (489)..(489): a, c, t, g, unknown or other
  misc_feature (489)..(489): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccacggcccctgtgttagtgatataataaagacagtgagacggccctnagagactccctgagcgtattctctggcctccagtcctcgagggacagcagtctacgttagactatacagtagaacgtccgaggacgaaggaggacggacgtctgaacttagttactacgtaacaaacgngtaagacgtaagtagtagtacgtntaggttcgggtgttcgggngagggaccgagtctacggtaccgtcgtacggtacacggcccgaaggccctccggccccgtacgg

SEQ ID NO: 201066 - DNA, 436 bp, Homo sapiens
  misc_feature: GYAE6OF01BYV4J.21.46.E02.1.454.CMB.1.raw
  modified_base (424)..(436): a, c, t, g, unknown or other
  misc_feature (424)..(436): n is a, c, g, or t
tcagtcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggactggagtggttattattccgtggggccagggaaccctggtaaccgtctcctcagcctccaccaaggcccatcggtctccccctggccgccctgctccgaggcgcacctccgagacgcacagccggcccgtgggcctgccgtggtacaaggacctaccgttcccgagcgacgactgacgcgggctggcaaggcgcatagnnnnnnnnnnnnn

SEQ ID NO: 201067 - DNA, 796 bp, Homo sapiens
  misc_feature: GYAE6OF01CUGUQ.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccaccctggtgtcagtcgtccccaggacaggaccggccaggactcacctgctctgcagagtggactagaccaaaagaaattanaggtactttagttacggtaaccaaacgagaaacggccagggacccgtacggtccccttaggttgttaagtgtaattaataaataaacgactacgtaggacgtaccggcctacgaagacgtacttcccgaggaacgtaccgtactttcgtcggtacggtaccttacccgagacccgttaggaacgggggtaaccagggtaccgaacggtttacgtaacgggtttaacgtaaccgttaacgtaccggtaaggttaacgggtaaaaccgttccccggaaagggaacgggaaacggggtaaacggggtaaccggaagggttaccgtaaacggttaactttaaaccgtttaacggtaagttaaaccccgaaaagttaacggtaagaaaccgtaaggtaagaacgttacttacgtaggtttcggggtcggttaccggggacgggaacgggtaaaccgtacgggtaccttaacgggtaccccggttaacgttaacgggttaaccgacccggtacccggtaaacggtccccgttcccggccccggttaccccgg

SEQ ID NO: 201068 - DNA, 667 bp, Homo sapiens
  misc_feature: GYAE6OF01CNMQN.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgacggcctcctatgagctgacacagcccacccgtcggtgtcagtcgtccccaaggacaggacggccaggactcacctgctactgcagatggactgacaaaagtaatagtgtactttagttacggtaaccaagaagaacgccgaaggcccgacggtaccccgttaggttaggttaagtagtaattaataaagtaaacgactacgtagaacggacggtccctagaagtacgactccgtagagtaccgtatttccgtcgtcggtacctccgagcgtagaacgggtacagctagtactacgtttcgaacttagtcgtaagtacggtaacgtccgaaggcgaaaggacggacgtagtacgtagtactacttacgtacgaacgtaaagtgtaacgacgtaagtacgtaaggtaccttaggtaggtttgggtacggttacggggacggtaacggaacgtaacgggtcgtaaccgtccggttacgtacggtccaaaccgggtaccgaacggttccgcccggtccccgttaccgg

SEQ ID NO: 201069 - DNA, 595 bp, Homo sapiens
  misc_feature: GYAE6OF01DG3BC.21.46.E02.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaaccaacagaagccaggccaggcccctgtgtagtgatataataagacactgagacggccctacagagactccctgacgcgtattctcgtggctccagctcgaggacagcagtcacgttgacttancgtagtgaacgtccgaggtacaaggtacggacgaggcgtagtacttaagttacgtacgtaacctaaacgagtaagaacgtagtaagtacggtactacgttaggttcggggttacggttccgggacgggtacgggacccgtaaaggtcgttacggtaacccgttccgttacggtacgtaaccgacccgtaagggtcctcccggtccccccgttaccggg

SEQ ID NO: 201070 - DNA, 648 bp, Homo sapiens
  misc_feature: GYAE6OF01DETH9.21.46.E02.1.454.CMB.1.raw
  modified_base (241)..(241): a, c, t, g, unknown or other
  misc_feature (241)..(241): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaaccaacagaagccaaggccaggcccctgtcgttagtgattataataaagactacgtgacgaggccctanagaanactcccgtgacgtcgtatttcctcgtcggccttaccgagtccgtacgaagggggaccaaggccgtaacgttctaacggtttcgaacttacgtaccgtaagtacggaaacgttacccgagggtacgaaacgggtaggaaccggagggtcctacgaacctttaagtttaaccgtggttaaccaaaacgtggtaacgaacgtaagggtagtaacgggttataccgtaggttcggggtcgttacgggacggtacgggacaaggtcgtaccggtaccgttaccggtaacgtcgacgaccgacggtcctcccggtcccgttacccgg

SEQ ID NO: 201071 - DNA, 521 bp, Homo sapiens
  misc_feature: GYAE6OF01DWVPC.21.46.E02.1.454.CMB.1.raw
  modified_base (241)..(241): a, c, t, g, unknown or other
  misc_feature (241)..(241): n is a, c, g, or t
  modified_base (368)..(368): a, c, t, g, unknown or other
  misc_feature (368)..(368): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaaccaacagaagccaggccaggcccctgtgttagtgatatataaagacactgagaggccctcaagagactccctgagcgattctctggctcagctcgagggacagcagtcacgttnactatcagtgaagtcaggacaggaggacgaggctagtactattactgtacaaacgtagtagacagtagagtactctagttgggtcgttcgggacggagggaccaaggcgtaggacccgtcgtaggtcacggacccaaggcctcgccccgtcgg

SEQ ID NO: 201072 - DNA, 565 bp, Homo sapiens
  misc_feature: GYAE6OF01D4HFL.21.46.E02.1.454.CMB.1.raw
  modified_base (321)..(321): a, c, t, g, unknown or other
  misc_feature (321)..(321): n is a, c, g, or t
  modified_base (444)..(444): a, c, t, g, unknown or other
  misc_feature (444)..(444): n is a, c, g, or t
  modified_base (464)..(464): a, c, t, g, unknown or other
  misc_feature (464)..(464): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgcagatggactgaccaaaagaaatatgcttagttcggtaaccaacagaagccaggccaggccctgtgttagtgatataataaaagacactagagacggccctanagacgactcccgtgacggctattctcgtggcctaccagctacgagggacagcagtactagttgactatcagtagaaacgtcaaggacaggacgagagctgaactatactagtaacaatagtanacgagtaagaggttaacctnaaggtttgggcggttacgggacgggtaacgggtaaccgaggtccgtacggaacccggtcgtaacggtacgacggacccgtaaggccgtaccgccccgtacg

SEQ ID NO: 201073 - DNA, 882 bp, Homo sapiens
  misc_feature: GYAE6OF01D3XA6.21.46.E02.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctctatgagctgacacagcccaccctcggtgtcagtcgtccccaggacagacggccaggatcactgctctgcagntggactgaccaaagaatntgtacttattggtaaccaacagagccagccacgcccctgtgtagtgatataataaagacacgtgagacggcctacgagagactccctagacgacgtacttcctacgttcgggccttaccgacgtaccgtacggaacggggtaaccgacggtaccggtaaaggttaccccgtaaaccgggttttacgttaaccgtttaacgttacggttaaacggttagggtaaaaacccgggtttcccggaaacggggaccggaaaaggggaaaccggggtaaccgggtaacggggtacccgttaaaccggttaaacctttaaaccgttttaaccgtttaacggttaacccgtaaaaaccgtaaaggttaacgggtaaaaccgttaaacggggttaagggttaaaccgggtttaaacgttacccggtttaaggggttttgggggtttttaaccgggggtttacccggggttaaacccggggggaaaccgggggttaaaccccgggtaaaaccggttaccgggttaacccgggttaacccccggtttaaccgggttaaccggggttaacccgtaaaccccggggttaaacccccgtaaaccgggggtttccccccgttacccggggtcccccccccggtttaaaccccgggg

SEQ ID NO: 201074 - DNA, 517 bp, Homo sapiens
  misc_feature: GYAE6OF01ECLRT.21.46.E02.1.454.CMB.1.raw
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
  modified_base (428)..(428): a, c, t, g, unknown or other
  misc_feature (428)..(428): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacatgagagccctnagagatcccgtgagcgattctntcggctccgagcctcgagggacagcagtcacgttagactatcagtgaagtccgagcgaggaggacgaggctagactattactagacaacagtaanaacagtaagaggtactctagttgggtgtcgggacggagggacgagcgtgacccgtcgtaggcacgacccaaggcctcgcccccgtacgg

SEQ ID NO: 201075 - DNA, 572 bp, Homo sapiens
  misc_feature: GYAE6OF01A1FH3.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgtcttattggtaaccaacagaagccaggccaggcccctgtgttagtgatatataaagacacgtgagacggccctnagagactcccgtgacgcgacttctcgtcggctccgacgtctcgaagggacagcagtcacgttcgactatcagtagaacgtccgaggcaggaggacgaggctagacgttactacgtacgtaacaacgtagtaagacgtaagtacgtaggtactacgtagttgggtcggttcgggcgggaacggacgacggtcgtacgggtaccctaccggtaggtacgtaccgacccgaaaggccgtccgccccccgttacggg

SEQ ID NO: 201076 - DNA, 677 bp, Homo sapiens
  misc_feature: GYAE6OF01C5Y6E.21.46.E02.1.454.CMB.1.raw
  modified_base (260)..(260): a, c, t, g, unknown or other
  misc_feature (260)..(260): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctctgcagatggactgaccaaagaatatgacttataggtaaccaanagaacgcaggccacggccctgtagttagtgaatataataaagacacgtgagacggcctagagacgtactaccgtgagcgtacttcgtcgtcggcctccgagtcctacgaacgggacagcagtacctagttacgactatcgtaggtagaacgtcccgaaggacgaaagggacggaacggacggtacgtacgtaactttaacgtttaccgtagtaacctaaacgtaacggtaacgaacgtaaagggttaaggtaaccggttacttaacggttaagggtttcgggggttacggttacggggaccggggtaaacgggaacccgtaaagggtcccgtaaccgggttaacccggttaccgggttacggttaccgaaccggtaaccccggtaaggtcccgttccccggccccccggttaccggg

SEQ ID NO: 201077 - DNA, 579 bp, Homo sapiens
  misc_feature: GYAE6OF01ETBXC.21.46.E02.1.454.CMB.1.raw
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgacttaattggtaaccaacagaagccaggccaggcccctgtgttagtgatatataaagacatgagaggcctnagagactcccgngacgctattctctggctcagctcgaggacagcagtctacgttagactatcagtagaagtccgagcagaggacgaggactgacttattactagtacaaacgtagtaagaacgtaaggtagaacggttacgtacgtaggtttggggtcgtttaccggggacgggtaacggggtaaccgtaacgggtcgtacggtacccggttacgtacgggtccaaccggaccccgaaggtcccgtcccgtcccccggttacccgg

SEQ ID NO: 201078 - DNA, 598 bp, Homo sapiens
  misc_feature: GYAE6OF01DVKU2.21.46.E02.1.454.CMB.1.raw
  modified_base (240)..(240): a, c, t, g, unknown or other
  misc_feature (240)..(240): n is a, c, g, or t
  modified_base (437)..(437): a, c, t, g, unknown or other
  misc_feature (437)..(437): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtcccaggacagacggccaggatcactgctctgcagatggactgaccaaagtaaatntgactttattggtaaccaacagaacgccaggccacggcccctgtgttagtgtaatataataaagacacgtagacgacggccctagagagtactccgtaggacgtacgtacttctcgtacggctccgagtcctacgacgggacacgacacgtcgtacgttgacttactcgtagtacgaacgtcaggcaaggaggacgngcgtagacttagttactgtacaaacggagtacggaactaggtacgtaacggttactacgtaggttacggggttcgttacggggccggaacggtaccgaggtacgtcggtaccgtacgtacgtacgccgtaaccgaggtaccgtccggtccccgttaccggg

SEQ ID NO: 201079 - DNA, 705 bp, Homo sapiens
  misc_feature: GYAE6OF01AS925.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactttctgcacaggctctgaggcctcctatgagctgacacagcccaccctcggtgtcagtcgtccccaggacaggaccggccgaggactccacctgcctcgtgcgagagtcggactcgaaccaaagtaatagtacgtactttagttacggtaaccaacgaaggtaaccgccgacggacccgaccggtcccgttaggttacggttagtagtaattaagtaaacgtaaacgactacgtaggacggaccggtaccctagaacggtaacgtacctcccgtaggacgtcgttacttccgtcggtcggtcctaccggacgtaccggtacggaacggacacggtacgtaacgttccgttacggttacactagtacggaggtaacgaacgtaccgagacggaaggacgggacggagtacgtacgtacttacgtacgtacgtaacaacgtagtaacgaaggttaggtacggtacgttactacggtaggttacgggtacggtacgggacggtaacggaccgtaggtccgtaccggtaccggtacggtacgtaccgaccgtacctacgtacgcccgtcccgtccccgttacg

SEQ ID NO: 201080 - DNA, 550 bp, Homo sapiens
  misc_feature: GYAE6OF01BSSCW.21.46.E02.1.454.CMB.1.raw
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctagtgttagtgatatataaagacactgagaggccctcagagatccctgagcgattctctggcctcagctcgagggacagcagtcacgttnactancagtgacgtccaggcagaggacgaggctgacttattactgtacaacagtaanacgtaagtagaggtactcgtagttgggtggttcgggacgggaacgggtaccgaaggtccgttacggacccgttccgtagggttaccacggtaccccaaagggtccctaccggtccccccgttaccggg

SEQ ID NO: 201081 - DNA, 608 bp, Homo sapiens
  misc_feature: GYAE6OF01B93MH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtccagtcgtccccaggacagacggccaggatcacctgctctgcagatggactgaccaaaagaatatgtcttattggtaccaacagaagccaggccacggcccctgtgttagtgatatataaagacactgagagcctacagagtactcctgagcgtattctctggcctccgagctacgagggacagcagtcacgttgactatcagtagaagtcccgaggacaagggaggacggacggctaggtaacttagtttaactgttaaccaaacgtaaggtaacgacgtaaagggtaaggtaacggttaacctagtaggtttcggggttggttaccggggacggtaacgggaacccgtaagtccggtacggtacccggttacccgtagggtcccgaaccggtacccgaacgggctcccggtccccccgttaccggg

SEQ ID NO: 201082 - DNA, 510 bp, Homo sapiens
  misc_feature: GYAE6OF01EQMWU.21.46.E02.1.454.CMB.1.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
  modified_base (418)..(418): a, c, t, g, unknown or other
  misc_feature (418)..(418): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaagacactgagaggccctnagagatcccngagcgattctctgctccagctcagggacagcagtcacgttgactatcagtagagtccaggacagaggacgaggctgactattactgtacaaacngtagacagtaagagtactcagttgggtgtcggacggagggaccaggcctaggaccgtccgtagtccgagacccaaggcctcgcccccgtcgg

SEQ ID NO: 201083 - DNA, 547 bp, Homo sapiens
  misc_feature: GYAE6OF01DP333.21.46.E02.1.454.CMB.1.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (425)..(425): a, c, t, g, unknown or other
  misc_feature (425)..(425): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatntgcttattggtaccaacagaagccaggccaggcccctgtgttagtgatatataaagacatagagaggccctnagagatccctgagcgtattctcgtggcctccagtctacgaggggacagcagtcacgttgactatcagtgaagtcaggacaggaggacgaggctagactattacgtgtacaaanagtaagactagtaagtaggttactacgtagtttggggtgttacgggacggagggaacccgtaaggctacggaccgttccgtagggtactacggacccaagggtccctcggcccccgttacgg

SEQ ID NO: 201084 - DNA, 711 bp, Homo sapiens
  misc_feature: GYAE6OF01EBKFT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggactccacctgctctgacagagtggactcgaccaaaagtaatatgtactttattcggtaaccaacaagaacgccgacggaccgacggcccctgtacgttagtgtatataataaagactactagagacggcctacagacgactccgtgacgcgtattcctcgtcggtcctaccgagtaccgtacggaacgggaccacgtccgaacggttacctaacggttgtaacgttaacgtacgtaagtacgtaacgtacccgaggaacgaggaacggacggacggtccgtagtaacttacttacgttacgtaactaacgtaacgtaacggaacgtaaggtacgtaacggttactacgttaggtttcggggtacggttaccggggtaggggaaccggtaaccggtaaacggtacccggttaccggtaaacccgggtacccgtttaacggggacccgtaaccggtaacccccggtagggtacccccgttccccgggtccccccggttaacccggg

SEQ ID NO: 201085 - DNA, 590 bp, Homo sapiens
  misc_feature: GYAE6OF01B9MN9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctcctgctccccctcctcactttctgcacagtctctgaggcctcctatgagctgacacagccaccctcggtgtcagtgtccccaggacaaacggccaggatcacctgctctggagattcattgaccaaaagatatacttgttgttcagcagaagtcaggccaggccctgtactggtcatccatgagccagtcgacgacactccgggatccctgagagtattctctcgcctcagctcgagggacagtcggaccctacttgacctagtcgaggtcgggcccagggtgacgagtgaagctagacttactattgtacgcaccagacacgtagtcgtacagtacggtaggggtattcgggacgggacgggaaccgtaaggttcgtacccggttcgtttcgggtaccgtacggaccccggaagggtccctaccgggtccccccgttacgggttacccaaccgttccgttccgttcccccggttacccccg

SEQ ID NO: 201086 - DNA, 735 bp, Homo sapiens
  misc_feature: GYAE6OF01AF66Z.21.46.E02.1.454.CMB.1.raw
  modified_base (498)..(498): a, c, t, g, unknown or other
  misc_feature (498)..(498): n is a, c, g, or t
  modified_base (624)..(624): a, c, t, g, unknown or other
  misc_feature (624)..(624): n is a, c, g, or t
  modified_base (658)..(658): a, c, t, g, unknown or other
  misc_feature (658)..(658): n is a, c, g, or t
  modified_base (692)..(692): a, c, t, g, unknown or other
  misc_feature (692)..(692): n is a, c, g, or t
tcagtcgtcgctcgcacgaccggtgctcgatttagactcatctacaggggaaagggggtgggtccaggaggcgagaactctgggtgtctcaccatggcctcggatcctctacttctcccctcctcactctctgcacacggctctcgacgcctcctatgagctgacacacgccaccgtcggtctcacgtcgtacccgaggacacggacggccaggtatcacgttgtctctgctagactacggactacgaaccgtaaagtaaatcgtacgtactttaacgttacggaaccaacgtaacggaacgtacccgtaaccgggtaccgtaaccgggtaccccgttagggttacggtttaacgtacgggtaaactttaaacggtaaacgttaaaaccggaccttaacggttacgggaacggtaacccgggtaccccttaagacggtaacgtacttacccggtaggaccgttacggtactttcgtaccgtcggtaccctaccggtanccggtacggacgggtactacgtacgtacgttaccgtaacgtttacgtaacttacgtacgtaagggtactaacgttacgaaggtaccggaaggtcgacggtacgtacgtacgtaacgtacgtacgtntaaaccgataggaactacgtagtaacgacgttcncggttagtgggttcgtcggacgtacgacctacgngtactcggttcgacacggtacacgagtccgtccggtccgtacg

SEQ ID NO: 201087 - DNA, 526 bp, Homo sapiens
  misc_feature: GYAE6OF01E323K.21.46.E02.1.454.CMB.1.raw
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagacggcccctnagagactcccgngagcgattctcgtggcctccagctcgagggacagcagtcacgttgactatcagtgaagtccgaggcaggaggacgagtctagtactattactgtacaaacagtagacagtagagtactgtagttggtggtcggacggaggaccgagcgtacggccgtccgtaggtaccgacgacccgaaggccctcgcccccgttcgg

SEQ ID NO: 201088 - DNA, 567 bp, Homo sapiens
  misc_feature: GYAE6OF01DW5H8.21.46.E02.1.454.CMB.1.raw
  modified_base (319)..(319): a, c, t, g, unknown or other
  misc_feature (319)..(319): n is a, c, g, or t
  modified_base (365)..(365): a, c, t, g, unknown or other
  misc_feature (365)..(365): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgctttattggtaaccaacagaagccaggccaggcccctgtgttagtgattatataaagacactgaggacgccctanagagactcccgtgagcgtattctcgtggcctccagctcgagggacngcagtcagttgactatcagtgaagtccgaggacgaaggacggacggaggtactacgaacttactttacgtagtaccaaactagtagaacaggtagtaggtactcgtagttgggtgttcgggcgggtagggaccgaagtcgtacggtacccggtacgttacggaccgtacggacccgtaggtcccgccgtccccccgtaccgg

SEQ ID NO: 201089 - DNA, 546 bp, Homo sapiens
  misc_feature: GYAE6OF01ANMGQ.21.46.E02.1.454.CMB.1.raw
  modified_base (288)..(288): a, c, t, g, unknown or other
  misc_feature (288)..(288): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcgacctgctctgcagatggactgacccaaagaaatatgcttattggtaccaacagaagccaggccaggcccctgtgttagngatatataaagacactgagaggccctacagagactcccctgacgtcgtacttctcgtcggctaccagcctcgagggaccagcagtcacgttagactagtcagtgaacgtcgaggacaggacggacgaggctagactattacngtaccaaatgtaanacgagtagagttactcgtagttgggtgttacgggcggacgggtacgtacgcgtacggcccgtacgtacggtcgacgacccgaggcctccggtcccccgtcgg

SEQ ID NO: 201090 - DNA, 554 bp, Homo sapiens
  misc_feature: GYAE6OF01B11V2.21.46.E02.1.454.CMB.1.raw
  modified_base (244)..(244): a, c, t, g, unknown or other
  misc_feature (244)..(244): n is a, c, g, or t
  modified_base (495)..(495): a, c, t, g, unknown or other
  misc_feature (495)..(495): n is a, c, g, or t
  modified_base (511)..(511): a, c, t, g, unknown or other
  misc_feature (511)..(511): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgnttattggtaaccaacagaagccaggaccaggcccctgtgttagtagataatagtaaagaccacgtgagacggccctagagagtactcccgtgacgcgtattcctcgtcggcctcgacgctacggaggacagctagtctacgttgaactatcaagtgaacgtcaggacaggacggacgaggcttagacttagttacgtagtacaaacgtagtaacgacaggtacgagttactacgtaggtgggtgtacgggnggaacggacgagtacncggtacccagtacggcgtagcccgaggcctccggcccttacgg

SEQ ID NO: 201091 - DNA, 800 bp, Homo sapiens
  misc_feature: GYAE6OF01D98RR.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtggtccaggaggcagaactctgggtgtctcaccatggcctggatccctctacttctcccctcctcactctctgcacaggctctgaggcctctatgagctgacacacgcctacccgtggtgtcagtcgtcccaggacagacggccaggatccacctgctctagcagatggacctgaccaaaagtaaatntgtacctttagttcggtaaaccaacgaacgaacgacccgaaggacccgaaccgggtacccccttagttacggttaacgtagtaatttaaacgtaaagttaaaacggacctaccgttaggaacggtaacgggcccctttagaacggaacgacttaccccgtgacggacgtaacttcgtcgtaaggtcctccgacgtacgtaccgacggggaaccacgacgaacggttcccttaacgggttacgtaacccttagttacccggaagtttacgggaaaccggttaccgaaggaccgaaagggttacggacggaagggttcctaacgggtaactttaacgtttacgttaacggtaaaccctaaaacgtaaacggtaagtaaccgtaaagggttaacgtaacggttaacgtccggtaaggtttacgggggttagttaccggggacggggtaaccgggtaaccgtacggttacccgtaccggttaaacccggaccccgttaggtacccgttacccgggtaacgtaaccgggtcccttccccggtccccccggtttaaccggg

SEQ ID NO: 201092 - DNA, 739 bp, Homo sapiens
  misc_feature: GYAE6OF01CH7AQ.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatcggactgaccaaaagaaatntgtactttagttcggtaaccaaacgagaacgccgaggcccacggtcccctaggttcgttagtgaattaagtaataaacgacacgtgaaggtacggccctagaagacgtactcccgtagacgtaccgtatttccgtcgtacggcctacccgagccgtacggaacgggaccgagacggtacgttacgtacgttacgtacgttaactacgtaaggtacgtaaccggtaccggtacggaacggaagggaacggtaaccgggacggtacgtaacgtaacgtttaacgtttaacgtaacgtaaacgaacgtaaaggtaacgaaacggtaagggttaaccggtacgttaccgttaggttacgggtttacggggtccgggtaaccggggtaacggggtaaccggtaaccggacggttaccggtaacccggtacccgttaccggttaacgggacccgtaccggaaccccggtacggcccccgttcccggtccccgttacccgg

SEQ ID NO: 201093 - DNA, 603 bp, Homo sapiens
  misc_feature: GYAE6OF01AMO98.21.46.E02.1.454.CMB.1.raw
  modified_base (244)..(244): a, c, t, g, unknown or other
  misc_feature (244)..(244): n is a, c, g, or t
  modified_base (325)..(325): a, c, t, g, unknown or other
  misc_feature (325)..(325): n is a, c, g, or t
  modified_base (363)..(363): a, c, t, g, unknown or other
  misc_feature (363)..(363): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatntgtcttattcggtaaccaacagaacgccaggccacggcccctgttgttagtgaatataataaagacacgtgaggacgcctnaggagactcccgtgaagcgtattcctcgtggctaccgngtcctacgaaggtacagcagtccgagttgactatacgtagtagtaacgtccgaggacgaacggaagggacgacggtgtacgtacttaatttacgagtaaccaaagtagtaacggaacgtaacggtaagtacggttaccgttgtaggttcggggtaggttacgggacgggtacgggaacgagtccgtacggtcccgtaccggtagtcgtaccgaccgaagtccgcccgtcccccgttcggg

SEQ ID NO: 201094 - DNA, 655 bp, Homo sapiens
  misc_feature: GYAE6OF01BHL53.21.46.E02.1.454.CMB.1.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatccacctgctctgcagagtggactgaccaaagaatntgcttattgtaccaanagaacgcgaaggccacggccctgtcgttagagtatataataaagcactgaagcggccctgacgagactcccgtaggacgtcgtattcgtacgtcggcctcgagtccgtacgaacgggtaccagtaccgtaagtaccgtacggttagaaccgttagtaccgtaggttacggaacgttaccgaaggggaccgaagggtaacgggaccggtaggttccgtagtaccttaagttacgtaagtaacaaacgtagtaacgaacgtaaggttaacggtacgttaactcgtagggtttcgggtgggttaccggagggtaaccgggtactaacggtcgttaccggtaccggttaccgtaggtaccgaccgtacccggaacggtccctcccgggtcccccgttacgg

SEQ ID NO: 201095 - DNA, 785 bp, Homo sapiens
  misc_feature: GYAE6OF01BI9K3.21.46.E02.1.454.CMB.1.raw
  modified_base (179)..(179): a, c, t, g, unknown or other
  misc_feature (179)..(179): n is a, c, g, or t
  modified_base (337)..(337): a, c, t, g, unknown or other
  misc_feature (337)..(337): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtntcagtcgtccccaggacagacggccaggatcacctgctctgcagatggactgaccaaaagaatatgtactttattggtaaccaacgaagaagccaaggccacggccccttggtacgttagtgtaatataagtaaagaccacgtgaagacggcccctanaaggagtactcccgtaggacgtacgtacttcgtcgtcggccttaccgagccttacggaacgggtaccaggaccgtaacgtaccgtacggttacgaaccttaacgttacgaaggtacggtaaacgttaccccgagggtacgaacgggaacgggaccggtagggtacgtacggtaacgttattaaccgttacggtaacctaaacgtaaggttaacggtaaccgtaaggttaacgggtaaacgtttacgttacgttaacggggtttaggggttaccgggttaccgggggacggggtaaaccggggtaacccggaaacggttaacccggttaccggggttaaaccccccggttaccgggttaacggggttaaccccgtaacccggggtaaccccccggaaagggggtttccccccgttaacccccggggttcccccccggttaaccccgggg

SEQ ID NO: 201096 - DNA, 714 bp, Homo sapiens
  misc_feature: GYAE6OF01D460A.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgagcctcctatgagctgacacacgcccacccgttcggtgtcagtcgtccccgaggacacgacggaccaggactcacctgcctctcgacgagtagtcggactacggaaccaaaagtaaatatcgtactttaacgtacggtaaccaaacgaacgaacgaccgaacggacccgtaccggtccccgttggttacggttagtacgaagttaataagtaaaacgactagtaggacggaccggtaccctagtaacgacgtacctaccgtagacgtacgtacttcgtacgtcgcctcgacgtcgtaccggaggaccagacgtacgtacctacggttactaacgttataccgtagtaacgtaacggtacgaagggtacggaacggacgggtaacggaggtacctaacgtaacttaccttaaccgtaggtaaacccaaagtacggtaacgaacgtaaggtaacgttacggttactaacggttggttacgggtacggtacgggacggtacgaaaccggtacgtacgacccgttacgcggaccgaccgtaccggacgtcccgtcccggtcccgtcggtacccg

SEQ ID NO: 201097 - DNA, 548 bp, Homo sapiens
  misc_feature: GYAE6OF01BYDYL.21.46.E02.1.454.CMB.1.raw
  modified_base (288)..(288): a, c, t, g, unknown or other
  misc_feature (288)..(288): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatatgtcttattggtaccaacagaagccaggccacggcccctgtgttagtnatatataaagacacgtgagacggccctgagagatccctgacgcgtattctctggcctcgagctacgaggacagcagtcagttgactatcgagtgtaacgtcaggcagacggagaggctagtacttagttactagtaccaaagagtaacagtagtagaggttactcgtagttggtacggtcggacgggaacggacgaacgtcgtacggtacccgtcgtacggacgtaccggacccaagggtcccgtccgcccccgttacgg

SEQ ID NO: 201098 - DNA, 803 bp, Homo sapiens
  misc_feature: GYAE6OF01CHNXP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttttccccctctcactctctgcacaggctctgaggcctcctatgagctgacacacgcccacccgtcggtgtcaggtcgtccccaggacaggaccggccaggactccaccgtgctcgtgcagagtcggactcgaaccaaaagaatatgtacttagttacggtaaccaacgagaacgaccgaacggcccgacggtccccgttaggttacggttagtagtaattaataaagtaaaacgtacacgtaggacggaccggtaccctacgaagacgtactccgtaggacgtcgtacttctcgtcggtcctaccgtacgtacgtaccggagggtaaccacggtacctaacggttaccgtaaccggttacgtaaccttagttacgtaggtaacggtaaccggttaccgggaacggtacgggaacgggaacgggacgggtacgggtaccgttaacgttaacgtttaacgttaaccggtaacgttaacgaaacgttaaggtaaccggaaagttaacggggttaaacgttaaacgggttaccttaaggtttacggggttacggggttacgggttaccgggggaccggggtaacgggtaaaccggtaacgggtacccggttacgggaccccggttaccgggtaacggtaccccgaacggtaccccgggacggtaccccgtccccggtacccccgtggttacccccg

SEQ ID NO: 201099 - DNA, 647 bp, Homo sapiens
  misc_feature: GYAE6OF01BDJ3C.21.46.E02.1.454.CMB.1.raw
  modified_base (263)..(263): a, c, t, g, unknown or other
  misc_feature (263)..(263): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (338)..(338): a, c, t, g, unknown or other
  misc_feature (338)..(338): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtcccccaggacagacggccaggatcacctgctctgcagatggactgaccaaaagaaatatgcttaattggtaaccaanagaacgcaggccaggcccctgtgtagtgatataataagacactgagacgccctnaganactcctgagcgtattcncgtggacctccagctcgagggacagcgtagtcacgttagactactactagtagaacgtaccgaggacgaaggaacgggaacgaggtacgtacgtaacgttaacgtttacgtacgttaacaaacgtaagtaacgtaacgaaggttaaggtacggttaacttacggttaggtttcggggttacggttaccggggtacggggtaaaccgggaccgtaaacggtcccgtaacgggttaccccgttaccggtaacgggtaccgtaaccggacccgtaaaccgggtcccggtcccggtcccccccgttacccggg

SEQ ID NO: 201100 - DNA, 715 bp, Homo sapiens
  misc_feature: GYAE6OF01CQ49T.21.46.E02.1.454.CMB.1.raw
  modified_base (234)..(234): a, c, t, g, unknown or other
  misc_feature (234)..(234): n is a, c, g, or t
  modified_base (695)..(695): a, c, t, g, unknown or other
  misc_feature (695)..(695): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctctgcacaggctctgacggcctcctatgacgctgacacagcccacccgtcggtgtcagtcgtccccaaggacaggaccggccaggactccacctgctcgtgcagntggactagaaccaaaagtaatatagtacttagttacggaaccaacgagaacgccgaggccacggccctagttagtagtgaatataagtaacgacacgtaggacgacggtaccctagaagacaccgtccgtaaggacgtaccgttagttcctcggtacggtacccttcgaacgtccgtacggacggggacaggtacacgttacgacgttacgtaacttaacgtccgtaaggtacgtaaacggtacgaacggacggaaacggaacgggaacggtacgggtacttaaccggtaactttaacgttacgtaagtaaacctaaggtaagtaacgacggtaaagacggttaacgttacgttaggtagggtttacggggtttacgcggggaacgggtaaacggaccggtaagtcccgttaacgggacccgtttccgggaaagttccaacccgggacccgagggttcccnccccggtccccgttaaccgg

SEQ ID NO: 201101 - DNA, 533 bp, Homo sapiens
  misc_feature: GYAE6OF01BK1JV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtcttattggtaccaacagaagccaggccaggcccctgtgttagtgatatataaagacactgagaggccctcagagactccctgagcgattctctggctccagctcgaggacagcagtcacgttgactatcagtgaacgtcaggcagaggacgaggctgactattactagtacaaacagtaagacagtaagagtactacgtagttagggtgttcgggcggaagggaccgaggtctacggtacccgttccgtagggtccacgacccgaaggcctcggcccccgttcccggg

SEQ ID NO: 201102 - DNA, 664 bp, Homo sapiens
  misc_feature: GYAE6OF01D2D8P.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacggccaggatcacctgctctgcagatggactagacaaaagtaaatntgtacttagttacggtaaccaacgaagaacgccgacggccgacggtcccctgtagttacgtagtaataataaagtaaacgactacgtaggaacgacgccctacgaagaacgtacctcccgaggacgtacgtacttcgtcgtacggcctaccgagcctacggaaggacaggcctacgtacgtacgttacgtacttagtacgtaagtacgtaacgtacgaggacgagggaacggacgaggtctacggtaacttaacgttacgtacgtaactaaacgtagtaacgagtaaggtaggtaacggttactagtagggttacggttggttaccgggacgggtaacggtaaccgtacggtacgtaaccggtccgtaccggtacggaccgtaccggaccggtaacgtcccgtacccggtccccgttaccgg

SEQ ID NO: 201103 - DNA, 733 bp, Homo sapiens
  misc_feature: GYAE6OF01D3LS4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacacgccacccgtggtgtcagtcgtcccaggacagacggcctaggatcactgctctgcagatcggactcgacaaagaatatgtacttattacggtaaccaacaagaacgaccgacggaccgacggtccccttggtaggtttagtgaattaagtaactaaaacgacctacgtagaacggtacggaccccttagaacgaacgtaccttaccgaggtacgtaccggtaactttccgtacgttcgggcctaccgagtaccgtacggaacgggaccgagccgtaaggttacctacggttactaactaagtacgtaaggttacgtaaaccggttcgaacggtacgaacggacgggtaacgtgggtactacggtaacttaacgttacgtagtaaccgaaactaggttaacgaacggtaggtaacggttaacggtttactacggttaaggtttggggggttaaccgttgggggacccgggtaacgggtaaccgaacgggttccgtaacgggttacccgtaccggttacgggaccgtaaccggtacccgaaggtcccgtccccgtcccgggttaacccgg

SEQ ID NO: 201104 - DNA, 691 bp, Homo sapiens
  misc_feature: GYAE6OF01C05ST.21.46.E02.1.454.CMB.1.raw
  modified_base (241)..(241): a, c, t, g, unknown or other
  misc_feature (241)..(241): n is a, c, g, or t
  modified_base (260)..(260): a, c, t, g, unknown or other
  misc_feature (260)..(260): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaaagaatntgactttatggtaaccaanagaagccaggccacggcccctgtgtagtgataataagtaaagacacgtagagacggccctagaagagaactcccgtagagcgtatttctcgttcggccttccgacgtctacggacgggacacgacgtacgtactacggttagtaactagtaccgtaaggtacggtaaacgtcccggaagggtacgaaacgggaacgggtaacggacgggtaccttacggaactttaacgtttacgtacgtaacgtaaaacgtaggtaagaacgtaagggtaggtaacggtacttacggtaggtttacggggtaggtttaccggggacggggtaaaccgggaaccggtaacggtacccggtacggtaaccccggttaccggttaagggtacccgtaccggaaccccggtaaggtcccggtccccggtccccgttaacccggg

SEQ ID NO: 201105 - DNA, 624 bp, Homo sapiens
  misc_feature: GYAE6OF01B6ASD.21.46.E02.1.454.CMB.1.raw
  modified_base (331)..(331): a, c, t, g, unknown or other
  misc_feature (331)..(331): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatatgtactttattacggtaaccaacgagaacgccgaggccacggcccctgtgttagtgtatataataaagactactagagacggccctanaggacgactccctaggacgcgtattccgtcgtcggcctcgacgtcgtcgagggacagtacacgttcgtacggttacgaacttacgtacgtaagtacgaacgtcgaaggcgaaggacggacgaggtactagtacttacgttacgtacgtaacgaaacgtagtaacgtacgtaagtaaggaagttactaggttaggttgggttcggtacgggacggtacgggaaccgtacggtacgtacggtacccgtacgtacggacgtaccggaccgaacggtccctccggtcccccgtacgg

SEQ ID NO: 201106 - DNA, 698 bp, Homo sapiens
  misc_feature: GYAE6OF01DS2C7.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacacgccacccgtcggtgtcagtcgtccccaggacaggaccggccgaggactcacctgctcgtgcagatggactgaaccaaagaatatcgtacttagttacggaaccaagaagaacgaccgacggccacggccctgtgttagtgaatataataaanctacgtgacgacgacctagagacgtactccgtagacgacgtacttcgtcgtacggcctaccgacggtcctacggaagggaccacggactacgtacgtacgttagtactacgtagacggtacgtaacggtacgaacggagtaacgggacggaacggacggtacttacgtaacttacgttaactaacgtaaccaaaacggtgtaacgtaacgtaagggttaacggtacggttaacgttagggtacgggtttaggggtaccgggttaccggggaacgggaaacggtaaccgtacgggttaccgtaccgggtacccgttaccggaacggttaccgaacccgggtaccccgaagggtcccgtacccccggtccccggttaccgg

SEQ ID NO: 201107 - DNA, 705 bp, Homo sapiens
  misc_feature: GYAE6OF01ASEQX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatccacctgctctgcagatggactgaccaaaagaaatatgtacttagttacgtaaccaaacgagaacgccgacggccacggtcccctgttagttagtagtataataataaagactacgtagacgacggccctagacgtaacgtacctcccgtagacggcgttaacttccgtcgtcggtcctacccgaggtcctacggaacggggaacacggaccgtaacgtaccgtacggttataaccgttatacgaggtacggtaacgtaccgaaggacgaacgggaaggacgggtacggtacgtacgtaacttaaccgttaacgtacgtaaccgtaaacgtagtaaacgacggtaagggttaaggtacggttaacgttaggttagggttacggggttcgggtaccgggacggggaaccgggtaacgacggttacgtcggtacccggttacggtacggtaccggaccgacccggaaccggtccgtccccggtaccccgttaccggg

SEQ ID NO: 201108 - DNA, 576 bp, Homo sapiens
  misc_feature: GYAE6OF01ASX9L.21.46.E02.1.454.CMB.1.raw
  modified_base (238)..(238): a, c, t, g, unknown or other
  misc_feature (238)..(238): n is a, c, g, or t
  modified_base (311)..(311): a, c, t, g, unknown or other
  misc_feature (311)..(311): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgcaaagaatntgcttattggtaccaacagaagccaggccaggcccctgtgttagtgatatataaagacactgagaggcccctnagagatccctgacgcgtacttctacgtcggctccagtctcgagggacagcgacgtctacgttgaactagtcagtagaacgtccgaggcgaggaggacgaggactgtactattacgtagtacaaacgagtaagacgtaagtaaggtaaggttaactacgtaggtttgggttcggttcgggacgggtaacgggtaccgaacgtcggtacggtcccgtaccgtacggtacgaccggacccaagggtcctcccggtcccccgttaccgg

SEQ ID NO: 201109 - DNA, 779 bp, Homo sapiens
  misc_feature: GYAE6OF01EXMCM.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatggactgaccaaaagaaatntagtactttaagtggtaaccaacgagaacgccgaggccacggcccctgtacgttagtgaatataataaagacagtggacgacggtaccctgaagagtactcccgtagagtctatttccgcgtcggcctccgagtcctacggagggtacacgtacacgtactacggttacgaactaacttacgaagttacggaacggtaccgaaggtccgtaaagggacgggaacgtacgggtaccttaacggaactttaacttaacggttacgaaaccgtaaaacggtaacggtaaacgtaaccggtaagggttaaaccgggtaacgggttaacctttacggttaagggttttacgggggttaccgggtttaacccggggggacccggggtaaaaccggggtaaacccgttaacggggtacccgtttaaccccggggttaacccgggttaacccggtttaaaccgggttacccggtaaaccggtaacccccggtaaccgggttccccgttaacccccccgggtccccccggggtttaaccccgg

SEQ ID NO: 201110 - DNA, 604 bp, Homo sapiens
  misc_feature: GYAE6OF01CXPPB.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgatataataaagacactgagacggccctacatagactccgtgagcgtatttcctcgtcggcctccgagtccgtacgaagggaccaggaccaggtctacggtttagacttaactcgtaaggtacgtaaacggtcccaagggcaagggacggacgacgggtctagaacttattacgtagtacaaacgagtaagacgagtagacgttactacgtagttgggttcggttcgggacgggtacgggaaccgtaacggctacggtcccgtaccggttacggtaccgaaccggacccgaacggtccctcccggcccccgttccggg

SEQ ID NO: 201111 - DNA, 803 bp, Homo sapiens
  misc_feature: GYAE6OF01DY0OJ.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggaccagacggccaggatcacctgctctgcagatggacctgaaccaaagtaaatntgtactttaagttcggtaaccaaacgacgaacgccgaggccgacggccccttgtagttagttacgaatagtaagtaaacgactaacgtaggacgacggccctacgagaagtactaccccgtagacgtcgtacttccgtcgtacgccttacgacgtcctacggaaggtaccgagtccgtaacggtccgtaacggtttcaacgttacgtaccgtaaagtacggtaaaccgttccgaacgggaaccgtaagggaaccgggaacggtacgggtaccgttaaggtaacctttaagtttaccggttacgtaacgtaaaacgaacggttaacgtaaacggtaacggttaacggtaacggtttaaccttaacggtacgggttttacggggggtttaccggttaaccggggggtacccggggtaaacggggtaaccccgtaaaaggggttcccggttacccgggtaaacccccggtttacggttaaccggggttaacccgtaacccgggaaccccggtaaacccggggttccccttaccccggggtccccccgtttaacccgggg

SEQ ID NO: 201112 - DNA, 525 bp, Homo sapiens
  misc_feature: GYAE6OF01BZJT3.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatntgcttattggtaccaacagaagccaggccaggcccctgtgttagtgatatataaagacactgagaggccctcagagatccctgacgcgattctctcggctccagctcgagggacagcagtcacgttgactatcagtgaagtccaggcagaggacgaggctagactagttactgtacaacgagtagacagtaagaggtactgtagttggtggttcggcggagggaaccgagtctacggaccgtccgtaggtaccacgacccgaaggcctccggccccgtaccggg

SEQ ID NO: 201113 - DNA, 510 bp, Homo sapiens
  misc_feature: GYAE6OF01A3RMZ.21.46.E02.1.454.CMB.1.raw
  modified_base (312)..(312): a, c, t, g, unknown or other
  misc_feature (312)..(312): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtccaggcagaggacgaggctagactattacngtacaaanagtagacagtagagttatnagttgggngttcggcgggaggaccgagcgtaggacccgtcgtaggtacacgacccgaagcctcgccccgtacgg

SEQ ID NO: 201114 - DNA, 739 bp, Homo sapiens
  misc_feature: GYAE6OF01EL7U2.21.46.E02.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacgccaggatcacctgctctgcagatggactgaccaaagaatatgtcttattaggtaaccaacagaacgccaggccacggcccctgtacgttagtgataataataaagacacgtagacgacggccctanaggatactcccgtagacgacgtacttctacgtcggtctccacgcgtacgacgggtacacggctagtacgtacgttagaacttacgtaccgtaggttacgtaaagtcccgaaggtaccgaagggaacggacgggaacggtaccgtacgtaaaccgtttaactttaaccgttaaggtaaccgaaaacgtaacgggttaacgaaacggttaacgggttaaaggtaaccggttaacgttacggtttaacgggtttgggggttaccgggtttaccgggggacggggtaaacgggtaacccggtaacgggtacccgttaccgggtaaccccggttaccggtttaaccgggtacccggtaaaccggtacccccggtaaacgggttcccccgttccccggtcccccccgggtttaacccggg

SEQ ID NO: 201115 - DNA, 777 bp, Homo sapiens
  misc_feature: GYAE6OF01EYV0W.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgtcttattggtaccaacgagaagccaggccaggcccctgtgttagtgatatataaagacactagagacgcctagagagactcctgacgcgtattccgtcgtcggtcctaccgacgtccgtacggacggggtaacacggtccgtaacggttaccgtaaccggtttagtaacttaacgttacgtagggttaacggtaaacggttacccgaagggaccgtaaacgggaacgggaaccgggtaacgggtacgttacggtaaccgtttaacgttttaaccgttacggttaacccgtaaaacgtaacggttaacggtaaaccggtaagggtttaaacggtaacgggtttaaaccgtttacggtaacgggttttggggggttacgggtttacccgggggacggggtaaaccggggtaacccggaaacgggttccgttaaccgggtaacccgggttacccgggttaacgggttacccggtaccggtaaacccccgggtaaccgggtacccgttccccgggtccccccccggtttacccggggg

SEQ ID NO: 201116 - DNA, 679 bp, Homo sapiens
  misc_feature: GYAE6OF01EAW9O.21.46.E02.1.454.CMB.1.raw
  modified_base (248)..(248): a, c, t, g, unknown or other
  misc_feature (248)..(248): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggactcacctgctctgcagagtggactgaccaaaagtaaatntgtactttagttcggtaaccaacagaacgccgaaggtcgacggtccccttgttaggttacgtagtataataataaaacgacctacgtaggaaggacggcccttagaagacgtactccgtagacgcgtacttcgtcgtcggcctccgacgtccttacggaacggggtaccacggaccgacgttaccgtacgtttagaaccttagtacgtaggtaggtaaccgttccgaaggtacgaagggaacggacggaggtacgtacgtaacttaacgttacgtacgtaacaaacgtgtaagaacgtaaggtagtaacggtacgttacgtagggtttcgggtacggtcgggaacgggtacgggaaccgtacggtcgtacggtaccgtaccggtagtaccgacggtacccgaacggtcccgtcccgcccccggttacccgg

SEQ ID NO: 201117 - DNA, 788 bp, Homo sapiens
  misc_feature: GYAE6OF01EBICP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccagggacaggaccggccaggatcacctgcctctgcagatggactgaccaaaagaatatgtacttaagttcggtaaccaacagaacgccgaacggccaacgggtcccccttaggttcgttaaggtagaattaataagtaaaaggactacgtaggaacgacgggccccttagacgaacgtacttacccgagtacgacgtactttctcgtcggccttccgagccgtacgacgggtaacacggtctaacggttcgtaacgttacggtaaccttacgtacgtaaggttacggtaaacgttacccggagggtacgaacgggacgggaaaccggtacgggtaccgttaaggtaaccgttttaacgttaaccgtacggttaaaccgaaaacggttaacggtaacggtaaaccgtaaggggttaacgttaacgggttaaccttacggttaagtttggggggttacgttacgggggtaaccgggaaaggggtaacccgtaagggtacccgggtaaccgggtaaccccggtttaccggtaacgggttaccgaacccgggtaccccgggtaaacgggtcccttacccccggggccccccggtttaaccggg

SEQ ID NO: 201118 - DNA, 846 bp, Homo sapiens
  misc_feature: GYAE6OF01B48J9.21.46.E02.1.454.CMB.1.raw
  modified_base (661)..(661): a, c, t, g, unknown or other
  misc_feature (661)..(661): n is a, c, g, or t
tcagtcgtcgctcgcacgaccggtgctcgatttagactcatctacagggaaagggggtggggtccacggaggcagaacgtctcgggtgtctcacctagtggcctggatccctctacttctcccctcctcactctctgcactacggctctgacggtccgttcctaattgagtctagacacagtccacccgtcggtgtctacgttcggtccccgagggtaccagggaccggccgacggacctccaccctggccttcggtcgacgagaacttcgggaacttcggaaccgtaaaaggaacttacgttcggtaccgttttaacgttaccgggtaaaccaaacgaacggtaaccgacccgaacggacccgtaaccgggtacccccgttgggttacggttaacgtcgtaactttaacggttaaagttaaaccggaccttacggttagggaaccggtaccggtaccccgttaagtacggtaacggtacctcccggtagaaccgtccgttactttccgtacgtcgccgtaccgtacgggttccgaacgggacgggaactaccggtactaacggttacccgtacgttactaaccgttacacggtacgtaacgacgtccgaacggtacgtagggaacgtacggtacgtacgttagtacgtttattaccggtnaaaccgtaagtacggttaacgaaccgttaggtacggttaacgtacttacgggtacggttacggggttaccggttacggggacgggtaaccggggtaaccgtaggttacccgaacgggttacccggtacggtacgggtaccgccggtacccgaaccgggtccttaccccgggtccccgttaccggg

SEQ ID NO: 201119 - DNA, 572 bp, Homo sapiens
  misc_feature: GYAE6OF01AB237.21.46.E02.1.454.CMB.1.raw
  modified_base (256)..(256): a, c, t, g, unknown or other
  misc_feature (256)..(256): n is a, c, g, or t
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaatatgcttattggtaccaacngaagcctaggccaggccccctgtgttagtgatatataaagacactgagaggccctcagagatccctgagtcgatttctacgtggcttccagtctcagggacagcagtcacgttgactatctagtgaacgtccaggcagagtacgaggtcngactattactgtacaanagtanaccgtagtacgaggttactcgtaagttcgggttgttacgggcggtaacgggtaccgaaggtaccgtacggaccccgttaccgtaacgggtttaccaaccgggtaccccgaaagggtcccgttccggccccccgtttacccgggg

SEQ ID NO: 201120 - DNA, 599 bp, Homo sapiens
  misc_feature: GYAE6OF01DV65F.21.46.E02.1.454.CMB.1.raw
  modified_base (429)..(429): a, c, t, g, unknown or other
  misc_feature (429)..(429): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgactttagttcggtaaccaaacgaagaacgcccgaacggccaacggccccccgtaggttagttacggttggtaattaataagttaaaacgaccaacgttaggacggacggtcccctacgaagagactaccccgtgacgcgtattctcgtggctccgagctcgaggacagcagtcacgttcgacttancagtagaacgtccgaggacgaagacggacgaggctagtacttacttacgtagtacaaacagtaacgacgagtagagtactagtagttgggttcggtacgggcggagggaccgaagtcgtcgtaccgtaccgtaggtaccgacgacccgaggtccctccgccccgtaccgg

SEQ ID NO: 201121 - DNA, 552 bp, Homo sapiens
  misc_feature: GYAE6OF01DLTQQ.21.46.E02.1.454.CMB.1.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaatctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaatntgacttattggtaaccaacagaacgccaggccaggcccctgtgttagtgatataataaagacactgagaggccctnagaagactaccctgagaagtacttcgtctaggcctccgaagctcgagggacagcagtcacgttgactatcagtgaagtcaggacagaggacgagctagactattacagtacaaatagtagaacgtagtagaggtactcgtagttgggtcgttacgggacggagggaccgtaaggcgtacggtacccgtaccgtaggtaccgtacggacccaagggcctccggtcccccgttacgg

SEQ ID NO: 201122 - DNA, 610 bp, Homo sapiens
  misc_feature: GYAE6OF01B4DQ4.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacacgcccaccctcggtgtcagtgtccccaggacagacggccaggatcacctgctctgcagatggactgaccaaaagaaatntgtcttattaggtaaccaacaagaacgccgaggccacggcccctgtgttagtgtaatataattaaagaccactaggacggacggcccctagaagacgtactccctagagtcgtacttctcgtggcctccagcctacgagggacagctagtcacgttcgactactcgaaggtacgtaacgtccgaggcaaggaacggacgaggtctagtaacgttattactagtaacaaacgtgtaagacgaagttacgagttacgtagtaggttcgggtcggttaccgggagggtaacggaaccgtagtccgtacggacccgttcggtaggtacccgaacggccccgaaggcccctcccgtcccccggttaccgg

SEQ ID NO: 201123 - DNA, 741 bp, Homo sapiens
  misc_feature: GYAE6OF01BJ2OF.21.46.E02.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctncagatggactgaccaaaagtaaatatgtacttagttacggtaaccaacaagaacgcccgacggcccacggtccccctggttacgttagtgattaataataaacgactacgtaggagacggtccctagagagactccgtagacgcggtacttctcgtcggtacctccgacgcgttacggacggggactacggaccgtacgtaccgttacggttacgtacttacgtacgtagtacggtaacgttccggaaggtaccggaagggaacggaacggtaggtaccgttacggactttaacgtttacggtaacgtaaccgaaaacgttaggtaacgtaacggtaaggtaacggtacgttaacgtgttaacgggttggggtttaggggtaccggggtaaccgggacggggtaaaccgtacggttacccggtaccggttacccgggttaccggttaccggtacccgggtaacccggtaacccggaaccgggttacccccggttccccgggtccccccggtttaccccggg

SEQ ID NO: 201124 - DNA, 643 bp, Homo sapiens
  misc_feature: GYAE6OF01DU1SV.21.46.E02.1.454.CMB.1.raw
  modified_base (221)..(221): a, c, t, g, unknown or other
  misc_feature (221)..(221): n is a, c, g, or t
  modified_base (338)..(338): a, c, t, g, unknown or other
  misc_feature (338)..(338): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtcgtccccaggacagacggccaggatccacctgctcngcagatggactgaccaaaagaaatgtgacttattggtaaccaacagaagccaggccacggcccctgtgtagtgataataataaagacacgtagacgacggcctacgagagactccgngagcgtacttcgtcgtcggcctcgacgtccgtacgaacgggacacgacgtacgtaccgtaacggtttgaaccgtttactaccgtaaggttacggaaacggttacccgaacgggacaaaggggaacgggacgggaacggtccgttaacggtactttaacgtttaccgtacgttaaccgaaacgtaagtaagaacgtaagtaggtacgttactacgttaggttgggtacggtcgggacggacgggaccgtagtcgtacggtccggtaccgttaggaccgacgaccgaggccctccgtccccggtccg

SEQ ID NO: 201125 - DNA, 575 bp, Homo sapiens
  misc_feature: GYAE6OF01BTQUJ.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataagacactgagacggccctnagagactcccgtgagcgtattctcgtggctcagctcgagggacagcagtcacgttgactatctagtgaagtcccaaggcaaggaggacgaggctagacttattactgtacaaacgtagtaagacgtaagtaggtaggttactacgtaggtttgggtcggttacgggacgggtaacgggtaacccgaaggtccgtacggtacccgttaccgtacgggtaccgtaccggaccccgtaaggcccgtcccggtcccccgttacccgg

SEQ ID NO: 201126 - DNA, 638 bp, Homo sapiens
  misc_feature: GYAE6OF01B30HC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaagaatatgacttagttcggtaaccaacgaagaacgccaggccacggcccctgtgttagtgatataataaagacacgtgagacggccctagagacgtactcccgtaggacgtcgtattctcgttggcctccgagtcctacgacgggacacgcacgtactacgttagactagtacgagtagtaacgtccgaggacgagggacggacggacggtctacgtaacttaagtttacgtaggtaacaaacgtagtaacgaacgtaagtaaggtacggttacttacgtaggtttcggggtacggttacggggaccgggtaagggaaccgtaacggtcgtaccggtacccggttaccggtacggtacgtaaccggacccgtaacggtcccgtcccggtccccccgttaccggg

SEQ ID NO: 201127 - DNA, 660 bp, Homo sapiens
  misc_feature: GYAE6OF01CNMW9.21.46.E02.1.454.CMB.1.raw
  modified_base (242)..(242): a, c, t, g, unknown or other
  misc_feature (242)..(242): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacggccaggatcacctgctctgcagatggaactgaccaaagaatntgactttatggtaaccaanagaagccaggccaggcccctgtgttagngaatataataagaccagtggaagtacgccctagaagagtactcccgtaggacgacgatttccgtcgtacggcctaccgagtctacgagggcctaggcaagttccgaacgttgaactactagaggttacgaaacgttcccgaaggacgaacgggtacgggaacgaacgggtcttaacgaacctttaagttacgtacgtaaaccgaaacgtaaggttaacgaacgtaaaggtaggtaaacgttacttagtagggttagggtacggttacgggacggacgggttaaccgaacggtcgtaccggtaccccgttacggttaacggtaccgaacccggttaccgaaccggttccgtccccggtcccccgttaccggg

SEQ ID NO: 201128 - DNA, 763 bp, Homo sapiens
  misc_feature: GYAE6OF01B64MM.21.46.E02.1.454.CMB.1.raw
  modified_base (271)..(271): a, c, t, g, unknown or other
  misc_feature (271)..(271): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggacggccaggactccacctgctctgcagagtggactgaccaaaagtaaatatgtacttagttacggtaaccaanagaacgccgacggtccgacggtcccctgttacggttagtggaatttaataagtaaaacgtaccaacgttaggaacggtacggacccctacgaaggaacgtaccgtaccccgtaggacgtcggtaactttcccgtacgtcggtcccttacccgacggtccctacggaacgggggtaccaacgggtacctacgggtaccgttaacggttacgtaaccgttcgttaaccgtaagggttacggaaaccgttacccgagggaccggaaggaacgggaacggtacggacgttacggtaactttacgtttaccgtagtaaaccaaacgtacgtaaggtaacggtaaggttaacggtaacggttacgtacgttagggtttacggggttcggttaccggggaaccgggaacgggtaacccgaacggtccggtaacgtacccgggttacgtacggtaccgaaccggacccgtaagggcccttccccgggccccgttaccggg

SEQ ID NO: 201129 - DNA, 710 bp, Homo sapiens
  misc_feature: GYAE6OF01BN3UP.21.46.E02.1.454.CMB.1.raw
  modified_base (260)..(260): a, c, t, g, unknown or other
  misc_feature (260)..(260): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaanagaagccaggccaggcccctgtgttagtgatataataaagacacgtagagacggccctacgaagacgactccccgtaggagtccgtatttcctcgtcggtacctaccgagtcctacgagggactacgacgtacgtaccgtacgttacgaacttactacgaaggttacgtaacgtcccgaaggtacgaaggaacgggacgacggtactacgtaacgttattaacgtacgtaaccgtaaaacgtgtaacggtaacgtaagggttaaggtaacgggtttaacctacgttaagggtttacgggggttcggttaaccggggaccggggtaaaccggggtaacccgtaaacgggtcccgttaccggggtaaccccggtttaccggttaacgggacccgtaaccggacccccgggtaaaggtcccccgttaccccgggtccccccggtttacccggg

SEQ ID NO: 201130 - DNA, 717 bp, Homo sapiens
  misc_feature: GYAE6OF01C98Q3.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctgcagatggactgaccaaaagaatntgacttattggtaaccaacagaagccaggccacggcccctgtcgttagtgaatataataaagacactaggagacggccctacgagagtactacccgtgagacgtatttcctcgtggcctcccgagtccgtacgaacgggactaaacgacggtactacgttagtacctaagttaccgaggtacgtaacggttcccgaagggtaccgaaggaacgggaccggaacgggtccttaacggaacttaactttaccgttaggtaacctaaaacgtaggtaaacgaactaagggtaagtaggtaaccttacgtaagggttttacgggtcggtttaccggggaacggggaccggggtaacctaacgggtaccttacccggggtaaccccgtttcccgggtaaccgggttaccgaacccgggtaaccccggtaaacgggtccccgttaccccgggcccccccggtttccgggttaaccccccg

SEQ ID NO: 201131 - DNA, 759 bp, Homo sapiens
  misc_feature: GYAE6OF01BRUQ3.21.46.E02.1.454.CMB.1.raw
  modified_base (265)..(265): a, c, t, g, unknown or other
  misc_feature (265)..(265): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctggacggcctcctagtgagctgaccacacgcccacccgtcggtgtcagtccgtccccgaggacacggaccggccaggactccaccgtgtcctcgtgacagtagtcggactcgaacaaaagaatntcgtacttagttacgtaacaagagaacgaccgacggccaccggccccttaggtagttacggtagtaacgttaataaacgtaaacgacgacgtagaacgaccggtacctacgagaacgtacctccgagacgtcgtacttctcgtcgtacctccgaacgtccgacggtaacggaccgacgtacgtacgtaccgtacggtagtacgtactacgtagtacgtaacgtacgacacggggggggggggacacggacggtacgtacgtacgtacgttaacgttacgtacgtaacgtaaacgtaacgtaacggtaacgtaacgtaacggtaacgttacgttaacgttacgggttacgggttaccggggttaccgggggtaccggggtaaccgggtaacggtacggtaacccggtacccggttaccggttaccggtaaccggtaacccggtacccggtaaccggtaccccggttaccccggtccccggttacccggttacccg

SEQ ID NO: 201132 - DNA, 643 bp, Homo sapiens
  misc_feature: GYAE6OF01A069N.21.46.E02.1.454.CMB.1.raw
  modified_base (262)..(262): a, c, t, g, unknown or other
  misc_feature (262)..(262): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgactttattggtaaccaanagaagccgaggccaggcccctggttcgttagtgatataataaacgacacgtgacgacggccctagagagactccctggacgcgtattcctacgtcgcctccagtcctcgaacggggaacacgtacgaacgtcgtacggtttacgaacttagtacgtaacgtagaacggttccgaaggacgaaggaacggacggtaggaccgttagaacgttaacgttacgtacgtaactaaacgagtaacgacgtaaggtaggtaagttactacgtaggtttcggtcggttacgggaccgggtaacggaacggtaccgtaggtaccggtacccggtaccgtaagggtacccacggtacccgaaacgggtcctcccggtcccccggtaccgg

SEQ ID NO: 201133 - DNA, 643 bp, Homo sapiens
  misc_feature: GYAE6OF01D1WGZ.21.46.E02.1.454.CMB.1.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
tcagtcgtcgctcgcacgaccggtgctcgatttagactcatctacaggggaaagggggtgggtccaggaggcagaactctgggtgtctcaccatggcctggatccctctacttctccccctcctcactctctgcacaggctctgaggcctcctatgagctgacacagccacctcggtgtcagtcgtcccaggaccagaccggccaggactcacctgctctgcagatggactgaccaaagaatntgcttatgtacanagagcagcagcctgtgtagtnatatataagacacgtgagacgcctagagagactacctgacgtcgtattcctacgtcggcccttacgacgtacctacggacgggaactacgacgtaacgtaccgtaacgtttcgtaaccttactaccgtaagtacgtaaaccggtccccgtaaggaccgaaggtaaccgggaccgagggaccgttaggtaaactttgttaccgtacgtaaccgaaacgtaagtacgaacggtagtacggtacggttactagtaggtttcggggtacttacggggacgggtaacgaaccggtaacgtccgtacggtacccggttaccgtacgggaccgtaccggaacccgtaaggtcccgtccgttcccccggtacgg

SEQ ID NO: 201134 - DNA, 716 bp, Homo sapiens
  misc_feature: GYAE6OF01CUGIE.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaagaatatgcttattggtaccaacagaagccaggccaggcccctgtcgttagtgtaatataagtaaagacactgacgacggccctacgagagactcccctagagtcgtatttctcgtagggcctccgagtcctacggaagggacaggccagttaccgacggtttagaaccttagtaccgtaaggtacggtaacggtcccgtaagggacgaagggaacgggacgggtaacgggtaccgtaggtaaccttaagttttaaccgtacggttaaaccgaaaacgtaggttaaacggaacgtaacgggttaaggtaacggtttaacgttacgttacgggttttacggggtttacggttaccgggggaaccggggtaacggggaacccgtaaacgggtaccgttaccgggtaccccggttaccggttaacgggtcccaaccgggtaacccccgtaagggtccccgtacccggtccccccggttaacccggg

SEQ ID NO: 201135 - DNA, 659 bp, Homo sapiens
  misc_feature: GYAE6OF01EPQ6D.21.46.E02.1.454.CMB.1.raw
  modified_base (352)..(352): a, c, t, g, unknown or other
  misc_feature (352)..(352): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtcgtcccaggacagacggccaggatcgacctgctctgcagatggactcgaccaaaagaatatgtactttagttcggtaaccaacgaagaacgcccaacggccaacgggccccttggtgttaagtggaattaagttaataaaacggacacgttaggaacggaccggtccctanaaggactacgtcccgtaggacgcgtaatttcctcgtggcctaccgagtccgtacgacgggacaggcaacgtctacgttgaactacgtacaggtgaacgtcgaaggacgaaggacggaccgaggtctaggtacttaagtactacggtaacaaacgtggtaacgaacgagggttaagtacggttactaccgtaggtttggggtacggtttacggggacgggtaaacggacccgtaaaggtccgtacggtaccccgtacgttaacgggcctaaccgggacccgaggtcccgtcccggtcccccgtacggg

SEQ ID NO: 201136 - DNA, 532 bp, Homo sapiens
  misc_feature: GYAE6OF01C4V8S.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagaggccctnagagatccctgagcgattctctggctccagctcgagggacagcagtcacgttgactatcagtgaagtccaggcaaggaggacgaggctagacttattactgtacaaacagtaagacgagtagagtactacgtagttgggtgttcgggcgggtagggaccgtaaggctacggacccgtacgtaggtactacggacccgaggcctccgcccccgtaccgg

SEQ ID NO: 201137 - DNA, 534 bp, Homo sapiens
  misc_feature: GYAE6OF01CLQPM.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgcttattggtaccaacagaagccaaggccaggcccctgtgttagtgatataataaagacactgagaggccctacagaagactccctgacgcgattctctggctccagctcgagggacagcagtcacgttgactatcagtgaacgtcaggcaaggaggacgaggctgacttattactgtaacaacgagtaacgaagaggtaagaggtactagtagttgggtgttcggagggacgggaccgaaggctcggaccgtcgtaggtcacgacccgaaggcctccgcccccgtccggg

SEQ ID NO: 201138 - DNA, 738 bp, Homo sapiens
  misc_feature: GYAE6OF01C6SM2.21.46.E02.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccacccgtcggtgtcagtcgtccccaggacagacggccaggatcacctgctcgtgcagntggactgaccaaaagaatntcgtatttagttcggtaaccaanaagaacgccgacggccacggccccttgtgttacgtgaatataaataacgaactagtaggaacggacggtcccctagaaggacgtacctcccgtagacggacttactttccgtcgtcggccttaccgacgtcgtaccgaaggggaccagtccgaacgttactaacggttgaaccttaataccgtaaggttacgaaacggttccccgaagggtaccgaaagggtaacgggaacgtacgggttacgtaacggttaactttaacgtttacgtaacgttaaccgtaaaacgtacggtaaacgtaacgttaaggttaacgggaacgtttaccttaggttagggttttaggggtacggttaccggggacgggtaaccgggtaaccgtaacgggtacgttacccgggtacccggttaccgggttacgacccggtaccggaaccgaacggtttccctccccggtccccggttaaccgg

SEQ ID NO: 201139 - DNA, 704 bp, Homo sapiens
  misc_feature: GYAE6OF01DDKHX.21.46.E02.1.454.CMB.1.raw
  modified_base (238)..(238): a, c, t, g, unknown or other
  misc_feature (238)..(238): n is a, c, g, or t
  modified_base (303)..(303): a, c, t, g, unknown or other
  misc_feature (303)..(303): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgccaccctcggtgtcagtcgtcccaggacagacggccaggatcactgctctgcagatggactgacaaagaatntgacttaagtcggtaaccaacagaacgaccgacgccgacgcccttgtgtagtgtaatataataanacagtgacgcggccctagagtacgtactccgtaggacgtacgtacgttccgtcgtcggacctaccgtacgtccgtacggaacgggaccgtaaggaccgtaacgtttaccgtaacgggttacgtaaccgtttaacgtaccggtaagggtacggtaaaccggttacccggaacggggtacgaaacggggtaaccgggacgtaagggtaccgttaactaacgttacgtttacgtacgtaaacaaacggtaagttacggaacgtaagggttacgtaacggttcttacggttagggtttcggggtacggttacggggacgggtaaccgggtacacggtaccggtcggtaacccgtacggtacggtacgacccggaaccgtacgtaccccggtccgtacccccgtcg

SEQ ID NO: 201140 - DNA, 509 bp, Homo sapiens
  misc_feature: GYAE6OF01D38G1.21.46.E02.1.454.CMB.1.raw
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaaagaatatgctttattggtaccaacagaagccaggccaggcccctgtgttagtgatatataaagacactgagacggccctcagagactcccgtgagcgtattctctggctccagctcgagggacagcagtcacgttgactatcagtgaacgtccgaggcaggaggacgaggctgactattactgtacaaacagtaagacagtagagttacncgtagttgggtgtcggnggacggacgagctggccgtcgtaggtcacgccaggtctcgccccgtcg

SEQ ID NO: 201141 - DNA, 554 bp, Homo sapiens
  misc_feature: GYAE6OF01AGNGI.21.46.E02.1.454.CMB.1.raw
  modified_base (288)..(288): a, c, t, g, unknown or other
  misc_feature (288)..(288): n is a, c, g, or t
  modified_base (472)..(472): a, c, t, g, unknown or other
  misc_feature (472)..(472): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctgcagatggactgaccaaagaatatgacttattaggaccaacagaacgccaggccacggccctgtgttagngatataataagacactgagacggccctagagacgactcccgtaggacgtcgtacttctacgtcggcctaccgacgtcgtacgacgggacagctagtctacgttagactatacgagtacgaacgtccgaggcgagaggacgagtctagtactatcgtatacaactgtaagacgagtagagttacncgtaggtggtggtcggacggacggacgacggtcgcggtccgtcgtaggtacccgacgacccgaggccctccggccccgtacg

SEQ ID NO: 201142 - DNA, 705 bp, Homo sapiens
  misc_feature: GYAE6OF01A5JYF.21.46.E02.1.454.CMB.1.raw
  modified_base (293)..(293): a, c, t, g, unknown or other
  misc_feature (293)..(293): n is a, c, g, or t
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacgccaggatcacctgctctgcagtatggactggaccaaagtaatatgacttagttacggtaaccaacaggaagccaggccacggcccctgtgttagngatataactaagaccatgagtacggtaccctagaagtacgacttacccgtaggaacgccgtaactttcctcgtaggtccnccgtaagctaccgagggaacacgtcgtaagtaccgtaacgtttcgaacttagtacgtaaggtagtaaaccgtcgaaggacgaaggtacggacgaacgggtactacgtaacttgttaactaggttaaccaaaaggtcggtaaacgacgtaaagggttacgaaccgggtttacacgttaagggtttcgggggttggtttaaccccgggaggggtaaacggtaacccggttaaagggacccggttaaccggtacccgggtacccgttaagggtaacccgaaacccggtacccgtaaaggggtccccctttaccggaccccccccggtttaccggg

SEQ ID NO: 201143 - DNA, 249 bp, Homo sapiens
  misc_feature: GYAE6OF01C3CYQ.21.46.E02.1.454.CMB.1.raw
  modified_base (243)..(249): a, c, t, g, unknown or other
  misc_feature (243)..(249): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnnn

SEQ ID NO: 201144 - DNA, 526 bp, Homo sapiens
  misc_feature: GYAE6OF01BPYXL.21.46.E02.1.454.CMB.1.raw
  modified_base (313)..(313): a, c, t, g, unknown or other
  misc_feature (313)..(313): n is a, c, g, or t
  modified_base (461)..(461): a, c, t, g, unknown or other
  misc_feature (461)..(461): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgtagtgatatataaagacactgagacggccctnagagactccctgacgcgtattctctggctccgagctcgagggacagcagtcacgttgactatcagtgaacgtccaggcaaggaggacgaggctgacttattactgtacaaacagtaagactagtagagtactgagttgggtgtcgggnggagggaccgaggctcggtaccgtcgtaggtacacggacccaaggcctccggtcccccgtaccgg

SEQ ID NO: 201145 - DNA, 899 bp, Homo sapiens
  misc_feature: GYAE6OF01BJR7F.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactcctctgcacgagctcgtggacggtcccttactatggacgtctagaccaacgaccgcccctacccggttcgggttcgtaccgtacggttcccgtaccccggaagggaccgaacgggacccgggaccgtaaggtactacccgtaccgttcgtccttacgtcgacgaagtacgtcggaacctacgaaaccgtaaaaaggtaaacttacgtacgtacttttagtttaccggaaaccaaacgaaggaaccgaccgtaaccggaccgaaccggtccccgttaggttacggttaacggtagtaatttaaacgttaaacgtaaaaacggacctaacggtaacggaacgggtaccggtacccccttaggaaacggtaacgttaacccgttacccggtagggtaacggtaccgtttaactttcccgttcgggtacggtacccttaccgacgtccgtaacgggaacgggtacgaccggacggttaacgtaccggttacggttacgtaacgttacgttacggtaagggtacgtaaaccggtaccggaaacgggacggaacgggaacgggaacggtacggtacgtacgttaacgttaacgttacgtaacgaaaccgtaaacggtaacggtaacgaacggtaaggtaaggtaaccgttacgtacggttaggtttcggggtacggttacggggacgggaacggtaaccggacgttacggacccggttaccggttcgtaacgggtaccgaccggacccggtaggtcccgtcccggttccccggtaccgg

SEQ ID NO: 201146 - DNA, 746 bp, Homo sapiens
  misc_feature: GYAE6OF01DPF6X.21.46.E02.1.454.CMB.1.raw
tcagtcgtcgctcgcacgaccggtgctcgatttagactcatctacagggaaagggggtgggtccaggaggcagagctctgggaatctcaccatggcctggacccctctcctgcctccccttcctctactttctgcacagtctctgacgcctcctatgagctgacacacgcccacccgtggtgtcagtcgtcccaggaccaaaccggccaggactcacctgctcgtggactattcattacgaacctaaaagaattacttacgtttggttcggtaccagaccaagacggtcgacggcccgaaccgggtccccttaggtaaccgttggtaccacttacccgaagttcggaacggtcccgtaacggttccggaaccgtaccacccgggtacgggtaaccctcccgtaggaacgtaacggtacctttccgtcgtccgaccctaccggacgtcgtacgacgggtaactacggtccgtacctacgtttacgacgttacgcggtacgggtcgggaccgtggtacgggacgtagtagacgtcgtacgtaccgttacgttagttacggttaaccgctaaccgacgtaacgtaggtacgttcggtacgtagttacgggtacggggttcgtcggggtaacggtacggacggttaaccggttcgacccggttcgttacggtccgaacctacccggtcgtacccggtcccgcccccgttaggtacctacccgttccgttaccccgtccccgttcccccgg

SEQ ID NO: 201147 - DNA, 586 bp, Homo sapiens
  misc_feature: GYAE6OF01D4OAV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatataataaagacacgtgagacggccctcagagactccctgagcgtattctcgtggcctccagctcgagggacagcagtcgacgttagacttatcgagtagaagtcccgaggcaggacggacgaggctgtaacttagttaactgtaacaaacgtagtaacgacgtaaggtaacggaggttactacgtaggttgggttaggttccggggacgggaagggtacccgaaggtccgttacggtaacccgttccgtaagggtaccacggaccccgaagggtcctcccggcccccgttaccggg

SEQ ID NO: 201148 - DNA, 807 bp, Homo sapiens
  misc_feature: GYAE6OF01CV8OB.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctctatgagctgacacagcccaccctcggtgtcagtcgtcccgaaggacaggacgccaggtactcacctgctctgcaagagtcggactacggaaccaaaaagtaaattatcgtacttttaacgttacggaaaacccaagaaaggtaaacgaccgaacgggacccgtaacgggcccctttagggtcgttaaaggtcgtaaaagtttaaacgtaaaattaaaaacggtaccaacgtttaaagggtaacgggtaaccgggaccccttaaccgaaaggggaacgttaaccttcccccggttaaggaacggtaaccggttaattttaccccggtgttaccgggaacccttaccgaacggtccgttaacgggaacgggggtacacggtaacgtaccggttaacttacccggttaaggtaacgttaactacggtaaggtacgtaaacggtaccgaaggaccggaaggaacgggaagtacggacgtagtaacttaagtttaactagtaaccaaacggtaaagttaacgaacggtaaagtaacgggtaacgttaactaacggtaggtttacgggtacggttaccgggacgggtaacggaaccgaagtacgtacggtaaccgttacggtaacgacgtaccgaacccgaggtcccgtacgccccgttacgg

SEQ ID NO: 201149 - DNA, 648 bp, Homo sapiens
  misc_feature: GYAE6OF01A8N6X.21.46.E02.1.454.CMB.1.raw
  modified_base (258)..(258): a, c, t, g, unknown or other
  misc_feature (258)..(258): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacgccaggatcacctgctctgcagatggactgaccaaaagaaatatgcttattggtaaccaanagaagccaggccacggcccctgttgttagtgtaatataataaagacacgtgaagacggccctagaagagactcccgtagagcgtacttctcgtcgctccgagcgtacgaacgggacagcgacgtacgtacgttacgacgttaactcgtaaggttacgaaacgtccgaaggacgaaggacgggacgaggcgtacggtacttagttactaggtaaacaaacgtagtaacgaagtaggtaaggtacgttaccgtagtagggtttcggggttggtttaccggggacgggtaacgggaaccgtaaggtacccgttaccgggtacccgttacccggttaagggtaccgtaacggtaccccggtaacggtcccgtcccggtccccccggttacccgg

SEQ ID NO: 201150 - DNA, 747 bp, Homo sapiens
  misc_feature: GYAE6OF01DGEC8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggccctcctatgagctgacacagcccaccctcggtgtcagtcgtccccgaggacagacggccaggatccacctgcctctgacagatcggactgaaccaaaagaatatgcttagttacggtaaccaacgaagaacgccgaacggccaacggtccccctggttacgttaggtagtaactttaataaagtaaaacgacgtaaccgtaggaacggtacgggacccctacgaagaacgtacctacccgttagacgtacgttacgttccgtcgtcggtccctccgaacgtcgtaccggaacgggacacggacgtacgtcgtaacgttcgtaacttactaccgaagggttacgaaacgtccggaacggagaacgggacgggtaacgaggtaccgtacggtaactttaacgtttacgtaggttaaaccaaacgtaaggtaacgtaacgtaggttaaggtaacgttacgttaccggttaggtttacggggttcgggttaccgggaggggtacgggaaacccgtagggtaccgtacgggtaaccccgttacggtacggtaacccggacgtaaacccggaccggtacccgttcccggtcccccggttacccgg

SEQ ID NO: 201151 - DNA, 773 bp, Homo sapiens
  misc_feature: GYAE6OF01B7CGQ.21.46.E02.1.454.CMB.1.raw
  modified_base (293)..(293): a, c, t, g, unknown or other
  misc_feature (293)..(293): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacgccaggatcacctgctctgcagatggactgaccaaagaaatatgtacttagttacggtaaccaaagagaaagccaggccacggcccctgtgttagngaatagtaataaagacactgacgacggcctacgagagtactcccgtgacgtcgtattcctcgtcggcctccagtcctacgacggggtacacggtacacggtaccgttaacggtttcgaaccgttaacgttaccgtaagggttaccggtaaacggttacccccggaaaggggtccgtaaaacggggaacgggtaaccgggtaaacggggttacccgttaaacggtaaccttttaacgtttaaaccgttaacggttaaaacccgaaaacgtacgggttaaaacgaaccggtaaagggttaaacgggtaacgggtttaaccttaccggtaaagggttttcggggtaacgggtttaccgggggaccgggtaaacggggtaacctaaacgggtcccgttaaccgggtaacccggttaccgtacgggttaccctacgggaaccccctaagggggtcccttcccccggaaccccccggtttaccggg

SEQ ID NO: 201152 - DNA, 620 bp, Homo sapiens
  misc_feature: GYAE6OF01DPSHW.21.46.E02.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgccaccctcggtgtcagtgtccccaggaccagacggccaggancacctgctctgcagatggactgaccaaagaatatcgactttattcggtaaccaacaagaacgccaggccaggcccctgtcgtagtgatataataacgacacgtagacgacggcccttagagaacgtactccgagacgacgtacttacgtcgtggtcctccgagtcgtacgacggacgagcacgtcgtacgttcgacgttatcgagtagtaacgtcgaggtacgaggacggacgaggctagtaactacgtttacgtacgtaaccgaagtaacgtaacggtaacgtaaggttaacggaggttactacggttagtttagggtcgggttagggaccggtacggacgaacggtcgtacggtaccgtaccgtaggtaccgtacggacccgtaggtcccgtccggtccccgttacccgg

SEQ ID NO: 201153 - DNA, 523 bp, Homo sapiens
  misc_feature: GYAE6OF01A741R.21.46.E02.1.454.CMB.1.raw
  modified_base (242)..(242): a, c, t, g, unknown or other
  misc_feature (242)..(242): n is a, c, g, or t
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgcagatggactgaccaaagaaatntgcttattggtaccaacagaagccaggccaggcccctgtgttagtgatatataaagacactgagaggccctcagagatccctgagcgattctctggctccagctcagggacagcagtcacgttgactatcagtagaagtccaggcgagaggacgaggctagactatactgaacaagagtaagacagtagagtacgtntagttgggtgttcggcggagggaccgagtcgtaggccgtccgtaggtccgtaacgcccgaaggtcctcccggccccgttaccgg

SEQ ID NO: 201154 - DNA, 628 bp, Homo sapiens
  misc_feature: GYAE6OF01BCETH.21.46.E02.1.454.CMB.1.raw
  modified_base (245)..(245): a, c, t, g, unknown or other
  misc_feature (245)..(245): n is a, c, g, or t
  modified_base (462)..(462): a, c, t, g, unknown or other
  misc_feature (462)..(462): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactttctgcacagtctctgaggcctcctatgagctgacacagccaccctcggtctcagtcgtccccgggacaaacggccaggatcacctgctctggagatgcattgaacctaaaaaatttnttgttttttaggaccagcaagaagtcaggccaggcccctgtgttggtcatccatgaggacaggacgaccgacccgtccggggatcccgtagacgagtacttctcgtggcctaccgaactcgacggggacggtcggcctacggttgactttcgtcgacggtcggggacccgagggttgggacggtagtagaagtcgtagactactacgttcgttaacncgtagacaagaccgagactaggtcggtacagtcggaggggctacggttcgggcgggtaaggccgtagggttcgaccgttcgtaggtccacggacccgaaggtcccaccggtcccccgtcggctaccgttcgttacccgttacccctcccttcccgtcccgttcccg

SEQ ID NO: 201155 - DNA, 723 bp, Homo sapiens
  misc_feature: GYAE6OF01DSNN6.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctcggatccctctacttctccccctcctcactctctgcacaggctcgtgaggcctcctatgagctgacacagccaccctggtgtcagtcgtcccagacagacggccaggatcacctgctctgcagatcggactgaccaaaagaaactntcgtacttagttacggtaaccaacgagaacgaccgacggccacggtcccccgttggtacgtttaggtaggaattaagtaagttaaaacggacctaacgttcggaacggtacgggtccccttaacgaacgtaacgtaccgtaccccgtaggaacggtaccggttaactttccgttacgtccggggtacccttaccgtaacgtccgtacggaacgggacgtacgacgtacgttaccgtaacggtttcgaacttacgtacgtaggtacgaacgttcccggaaggacgaaggacggacgtaggaccgtagtacttagtttacgtacgtaacctaaacgagtaacgacgtaagggtagtacggttactacgttacggttagggttacgggttaccgggacgggtaagggtaccgtaaaggtcgtacggtccgtacgttacgggtacctaccggaccgtaaccgcgtcccggtcccgttacccgg

SEQ ID NO: 201156 - DNA, 745 bp, Homo sapiens
  misc_feature: GYAE6OF01ED8QX.21.46.E02.1.454.CMB.1.raw
  modified_base (257)..(257): a, c, t, g, unknown or other
  misc_feature (257)..(257): n is a, c, g, or t
  modified_base (535)..(535): a, c, t, g, unknown or other
  misc_feature (535)..(535): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacacgcccacccgtcggtgtcagtccgtccccgagggaccaggaccggccaggactccacctgctctgcagatggactcgaaccaaaagaattntgtacttagttggaaccaagagaacgccgacggccacggccccttgtggttacggtcactaccagtaggacgacgagggacgacccggacccgtccgggactcccgaggacgtacgtacttccgtcgtcggtacctaccgtaacgtcggaacggggtaccggtcggaccgttaggttcgtactttaccgtacggacgggtccgggggacccgtaggggtacgggaacggggtataggggaacgtcgtaacgtacttaaacgttcgttaacgttaaccngtacgacgaacgactacggcggaaggttaccggtacgtacgggttacgggacgggtacgttacgggttacgggggaccggggtaaccgggttacggtacggttaccggtccccggttaacgggttaccggacccggacccggtaaccccggacggtcccggttcccccgacccccgggttagttacccgtccgttcccgtttaccccccg

SEQ ID NO: 201157 - DNA, 628 bp, Homo sapiens
  misc_feature: GYAE6OF01D8GV2.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatatgtcttattggtaaccaacagaagccaggccacggcccctgtgtagtgatatataaagactactgagacggtccctgaagacgtactcccgtagacgcgtacttcgtcgtcggccttacccgagtccgtacggaagggacaacggaccgtagttaccttacggttagaccttataccgaggttagaaacgttcccgaagggaccgaaaggaacgggacggtaggtcttagactttaacttacgtagtaaccaaagtagtagaacgtaggtaagtacgttaacagtaggtttcgggtggtaccgggcgggtaacgggaccgtaggtcgtacggtcccgtaccgtaggtacccgacggacccaaggtccctccggtccccgtccggg

SEQ ID NO: 201158 - DNA, 621 bp, Homo sapiens
  misc_feature: GYAE6OF01BFCQ0.21.46.E02.1.454.CMB.1.raw
  modified_base (258)..(258): a, c, t, g, unknown or other
  misc_feature (258)..(258): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacaggacggccaggatcacctgctctgcagatggactgaccaaagaaatatgcttattggtaccaanagaagccaggccaggcccctgtgttagngatatataaagacactgagaggccctanagagactccctgacgcgattctacgtggccttccgagcctacgacgggacagcaagtcgtacgttgaactacgtactaggtagaaagttccgaaggcgaaggaacggacggagggtctagaaccttattaacgtcgtacaaacgtagtaacggacaaggttaagaggttacttactaaggtttcggggttacggttacggggacgggaacggggtaaccgtaaggaccgttacggaaccccggttaccggtaacgggtcgtaacggcccctaaagggtcccttaacccggccccccggttacccggg

SEQ ID NO: 201159 - DNA, 557 bp, Homo sapiens
  misc_feature: GYAE6OF01ANL26.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgtcttattggtaccaacagaagccaggccaggcccctgtcgttagtgatatataaagacactgagaggccctacagagactcccctagacgcgattctcgtaggtcctaccgagctcgagggtacagcagtcacgttgactatcagtgaacgtcaggcaggaggacgaggctagactattacgtagtacaaactgtaagacgtagtaggagtactacgagttgggtggttcgggacgggtacgggaccgaaggtcgtacggtacccgtaccgtacggtcgaccggacccgtaaggccgtccggcccccgttaccgg

SEQ ID NO: 201160 - DNA, 723 bp, Homo sapiens
  misc_feature: GYAE6OF01CL499.21.46.E02.1.454.CMB.1.raw
  modified_base (248)..(248): a, c, t, g, unknown or other
  misc_feature (248)..(248): n is a, c, g, or t
  modified_base (458)..(458): a, c, t, g, unknown or other
  misc_feature (458)..(458): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctggtgtcagtcgtccccaggacaggaccggccaggactcacctgctctgacagatggactgaaccaaaagaatntgtattagttacggtaaccaacgagaacgcgacggaccgacggcccttaggttgttaggtataactaagttaaagtaaacgaactacgtaggacggtaccggccctagaacggacgtacgtccccgtaggacgtacgtactttctcgtggtaccctcgaacgtccgtaggacgggaaccagaccgtagttaccgtacgttagaaccttancgtaagggttaacgaacggtccgaggacgaaggacggacgagggttaccaagtactttaataccgtaagtaaccaaaggtaagaacggtaacgtaaggttaaggtaacggttacgttaacgtagggttacgggttacgggttcccgggaaaggggaaccgtaacggaccggtccgttaaaccgggtccccggtttaacggtaccgggaaccgtaccggtaaccccggaacgggttacccccgtcccggccccggtttaacccggg

SEQ ID NO: 201161 - DNA, 761 bp, Homo sapiens
  misc_feature: GYAE6OF01EUHNM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctggaggcctcctatgagctgacacagcccaccctggtgtcagtcgtccccgaggacaggaccgccgaggactccacctgctctgcagagtggactgaccaaaagaatatgtacttagttcggtaaccaacaaggaacgccgacgggaccacggtcccccgttggtcgttaggtcgaattaataagtaaacgacacgttaggacggtacggccctagagagtactccgtagacgcgtacttctacgtgcctccgagccgtacggaggtacacgcgtacgtacgtacggtacgtaactactcgtaagtcggtaacgccgtaaggacgaggacggacgtcggactaggtaacttacgttacgtacgtaaccaaacgtacgtaagaacgtaagggttaacgtaacgggtttacttaacgggtaggttttacgggggttacgggtttacccgggggaaccgggtaaacggggtaaacccggtaaacgggttaccccggttacccggggtaaaccccgggtttaccggttaaccccgggacccgggttaacccccgggttaaccccggggttaaaacccgggtccccggttccccccgggggtaccccccggttttaaccccggggg

SEQ ID NO: 201162 - DNA, 765 bp, Homo sapiens
  misc_feature: GYAE6OF01CC9TW.21.46.E02.1.454.CMB.1.raw
  modified_base (176)..(176): a, c, t, g, unknown or other
  misc_feature (176)..(176): n is a, c, g, or t
  modified_base (741)..(741): a, c, t, g, unknown or other
  misc_feature (741)..(741): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtntcagtcgtccccaggacagacggccaggactcacctgctctgcagatggactgaccaaaagaatatgtactttaagttacggtaaccaacgaagaaacgcccgtaacgggcccaacggcccccgttgtaggtttaggagtaataataacgtaaaagaccaagtaggaacggacggtaccctacgaagaacgtactacccgtggaagtcgtaactttcgtccgtcggcctacccgaggtccttacggaacggggacacggtaccgaacggtaccttaacggttacgtaaccttaacgtacgaacggttacgaaacggttaccccgaagggaccgaagggaacgggaacgggaacggtccgtaggtaaaccttacgtttaacgtacggtaactaaacgtaacggtaacgaacgtaagggtaacgtaacggttacgttacggaggttttacggggtcggttaaccggggtacgggtaacgggtaaaccctaaggggtccctaaacgggtaccccggttaccggtaacgggttaccgaaccccgggtaaccccggaacgggtttccccncccgggtaccccccgtttcccggg

SEQ ID NO: 201163 - DNA, 618 bp, Homo sapiens
  misc_feature: GYAE6OF01EHOF1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggactcacctgctctgcagatggactgaccaaaagaaatatgtactttagttggtaaccaacgagaaacgccaggccacggcccctgtcgttagtgatataataaagacactagagacggcctgagagactccgtagacgtcgtacttctcgtggcctcgagcgtacgacggacagctagtcctacgttagactatcgagtagtaacgtccgaggacgaagacggtaacggaggtactacgacttaagttaccgttagtaacaaacgtaagtaagaacgtaggtaacgtaacggttacttacggtaaggtttggggtacggttacgggacgggtaacgggaacgacggtccgtacggtcccgtaccgttacgggactacggaccccgtaaggtccgttcccgcccccggttaccgg

SEQ ID NO: 201164 - DNA, 733 bp, Homo sapiens
  misc_feature: GYAE6OF01DYBSV.21.46.E02.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgagcctctatgagctgacacacgcccacccgtcggtgtccagtcgtccccaggaccaggaccgccaggactccaccgtgctctgcagagtggactgacaaagaatatgcttagttcggaaccaagagaacgccgtaggcccgacggtccctgtgttagtagaatataagtaaacgacacgtagacggacgccctagagacgtacctccgtaggaacgtcgttactttccncggtcggcctaccgacgtacctacggaaggacacgctacggtaccgtacgttacgacttaacgtgtaaggtcggtaaccgtcccgaaagggtacgaacggggaacggaacgggtacggtacgttaacgtaaccgtttaacgttaaccgttacggtaaacctaaacggtaggttaaacccgagtaagggttaacggtaacgttacgtcggtaagggttttcggggtaaccgggttaccggggagggaaaaccgggtaccgtaacgggtcccgttacgggaacccccgtttacgggaaccggttaccgaaccccgggtaccccggtaaggtcccgttccccccggaccccggtttaaccggg

SEQ ID NO: 201165 - DNA, 584 bp, Homo sapiens
  misc_feature: GYAE6OF01D4OR8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggcaggatcacctgctctgcagatggactgaccaaaagaaatatgactttattacggtaaccaaacgaagaaacgccaaggccacggcccctgtagttagtgaataataataaaagacaacgtaggagacggccctagagagtactcccgtagacgcgtattcgtcgtggcctccgagcgtacgagggacagcagtcacgttagactatacagtagacgtacgaggacgaggaggacgaggtctagtactattacgtagtaacaaacgtacgtaagacgtagtaaggtaaggttactacgtagttgggtacggttcgggacgggagggaacgacgcgtacggaccgtacgtacggacgacggacccgaaggcctccgccccgtacg

SEQ ID NO: 201166 - DNA, 860 bp, Homo sapiens
  misc_feature: GYAE6OF01E5BNM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgacggcctctatgagctagacacgacgcccacccgtggtgtcagtccgacccgaggacgacggacggcaggtactccgaccgtgctcgtggacagtacgtacggaactacgaaacgaaaagtaattacgttacgttacgtttaacgtacggaaaccaaacgaacggaaccgaccggaaccggtcccgtaaccggttccgtaggttacggttaagtaacgtaataagtaaaacgaacgtacgtacgacggaaccggacccgtacccgtagaacggtaccgtaaccgtccggtacggtacgtaccgtttaccgttccgttaccgggtaccgtacccgtaccgggtaaccgtaccgggttaaccggaacgggtaccgtaccgtaacggttaaccgttaaccggtttaaccgttaacggttaacgtaccggttaacggtaacgggttaaaccggtacccgggaccgggtaaacgggaacgggaacgggtaaacggtaccgggtaagttaccggttaacgtttaacgttaaaccgttacgtaaacgtaaacgtaaagggtacgtaaacggtaacggttaacgggtaacgttacgttacggtacgggttacgggttacgggtacgggaccgggacgggtaaccgacggtccgtaggtaccccggtacgtaccgggtacgaccggaccccgaggtaccccgtccccgttcccgtcccggttacccg

SEQ ID NO: 201167 - DNA, 629 bp, Homo sapiens
  misc_feature: GYAE6OF01DQDQJ.21.46.E02.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatggactgaccaaagaatatgtacttattcggtaaccaacagaacgccaaggccacggccccctgtcgttagtgatatataaagacactgagagccctagagagatcctgagctattcncgtgcctcagctcgagggacagacgagtacacggtttagacttatctaggtagaacgtccgagggtacgaaggtagggaacggaggtaccgtaggtaactttaagtttaccgtagtaaccaaagaggtaacacgtaagtaggtacgttactacgtaggttgggttcggttacgggacgggtaagggaccgtaaacgggtccgttacgggtaccccggttaccggttacgggtacccgtaaccgggtacccggaacgggtcccgtccccggtcccccggttcccggg

SEQ ID NO: 201168 - DNA, 710 bp, Homo sapiens
  misc_feature: GYAE6OF01C5X46.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgactttaagttcggtaaccaacaagaacgaccgacggaccacggcccctgtgttaggtagtataagtaataaacgactactggacggacggccctagaagagaactcccgtaggacggacttactttaccgtcgttcgggccctaccgaacggtcctacggaacgggacctaaggacgtacgtaccgtacgttcgtaacttactacgaaggttagaacgtacgaggacgaaggaggaacggagcgttacgtacttaagtttacgagtaaacctaaacggtacgtaacgaaaccgtaggttaagaacggtttacttaacggttaggtttacgggttcgggttaccggggacgggtaacgggaacccgtaacggtaccgttaccgggttaccccgtaccggtttaacgggtaccgaaccggtaccccggtaaacggttccccggtacccgttcccccccgggttaccgg

SEQ ID NO: 201169 - DNA, 796 bp, Homo sapiens
  misc_feature: GYAE6OF01COSJY.21.46.E02.1.454.CMB.1.raw
  modified_base (175)..(175): a, c, t, g, unknown or other
  misc_feature (175)..(175): n is a, c, g, or t
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagccaccctggtntcagtcgtcccaggacagacggccaggactcacctgctctgcagatggactgaaccaaaagaaatntgactttaattcggtaaccaacgagaaacgcgaacggccacgggtccccttggttacgttagtacggtaattaattaaagtaaacgactaacgtaggaacggacggtcccctaagaagaacgtaccgtacccgtaggagtaccggttactttccgtcgttcggtcctaccgacgtaccgtacggaacgggaccacggactaaccggttaccgttaacggttacgtaaccgttaacgttaccgtaacggttacggtaaaccgttacccggaaagggtaccgaaaggggtaccgggtaacggacgggttaaccgttacgtaaaccgtttaacgttttaaccgtaacgtttaaaccgaaacggttaggtaacgtaaaccggtaaggttaacgggtaagttaccgttaacgttagggttacggggtttacggtaccggggtacgggtaacgggtaaccgtaaacgggtccgtaaccggttaacccgttacggttaccgggttaaccgaccggtaccggaaacccggtcccgttaccccggtccccccggtttaacccgg

SEQ ID NO: 201170 - DNA, 793 bp, Homo sapiens
  misc_feature: GYAE6OF01CB1GK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacacgcccacccgtcggtgtcagtcgtccccgaggacacggacggccgaggactccacctgctctgacagtagtcggactagaacctaaaagaatcgtagtactttagtacggtaaccaacgagaacgccgacggccgacggtcccctggtacggttagtgtaataacgtaataaacggactacgtaggacggtaccggtaccctagtaacgacgtaccttcccgaggacgtaccgttatttccgtacggtcggaccctaccgacggtccgtaacggacgggacctacggtcgtacgtaccgtacggttacgaaccgttagtacggtaacggtacgggtaaccgtacccggtaagggaacgaaacggggtacggaaccgggtacggtacgttaaccgtaacgtttaacgtttaccgtaaggtaaaccctaaagggttacggttaaacgacccggtaaaggttaccgggtaacggtttacttaaccgggttagggtttcggggttacggtaccggggaaccggggtaaaccgggtaccgtaggttacccggtaccgggttaacccggtaccgggttaccggaccgttaacccggacccgtaaggtccccgtccccggtcccggttacccgg

SEQ ID NO: 201171 - DNA, 779 bp, Homo sapiens
  misc_feature: GYAE6OF01D672G.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctcgacacacgcccacccttcggtgtcagtcgtccccaggaccacgacggccaggactccacctgctctgcagagtcggactgaaccaaaagtaaatatgtacttagttacggtaaccaagagaacgccgacggccgacggtcccttaggttcggttagtacgtaataataacgtaaagacctagtacggacggtaccgccctagaacggtacgtaccgttccgtaggacggtacgtacgttcctacggtcggcccttacgacgccgttacgaaggaccgcgacgtacgttaccgtacggttacgtactaccgtacgtaacgggtacgtaacggtacgtaacggacggaacgggtacgggaacccgggtagggtacccgttaaggtaaccgtttaaccgtttaacggttaaccgtaacgtaaaacgtaaggttaaacgaggtaaacggttaacggtaacggttaacttacgggttaggtttcggggttacgggttaccggggacgggtaaccgggtaaccgttaacgggtccggttaccggttaacccggtccggttaaaccggacccggtaccggtaaccccggtaccgggtccccgttccccgggtaccccccgttccgg

SEQ ID NO: 201172 - DNA, 588 bp, Homo sapiens
  misc_feature: GYAE6OF01CEVLN.21.46.E02.1.454.CMB.1.raw
  modified_base (179)..(179): a, c, t, g, unknown or other
  misc_feature (179)..(179): n is a, c, g, or t
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtntcagtcgtccccaggacagacggccaggatcacctgctctgcagatggactgaccaaaagaaatntgacttattggtaaccaacagaacgccaggccaggcccctgtgttagtgatataataaagacactgagacggccctgaagagactcccgtagagcgtattctcgtcggctccagcgtacgacgggtacagcgtagtctacggttcgacttatcaagtgaaacgtccgaggacaaggaggacgagtctagacttattacgtagtaacaacgtagtaagacgtaagtagaacgttactagtagttgggtagttcgggacgggtacggaaccgtaaggtccgtacggtacccggtaccgtacggtcgaaccggtacccgaaggcccttcccggcccccggttaccgg

SEQ ID NO: 201173 - DNA, 525 bp, Homo sapiens
  misc_feature: GYAE6OF01A3OR8.21.46.E02.1.454.CMB.1.raw
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (458)..(458): a, c, t, g, unknown or other
  misc_feature (458)..(458): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaatatgcttattggtaccaacagaagccaggccaggcccctgtgttagngatatataaagacactgagaggccctanagagactcccngagcgattctctggctcagctcgagggacagcagtcacgttgactatcagtgacgtcaggcagacggacgaggctgactattactagtacaaacagtagacagtagacgtactacgtagttgggtcgtacggngggacgggaccgaggtcgtggtacccgtacgtaggtccgacggacccgaaggcctcgcccccgtcgg

SEQ ID NO: 201174 - DNA, 916 bp, Homo sapiens
  misc_feature: GYAE6OF01CDY5B.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccacccgtggtgtcagtcgtccccaggacagacggccaggatcacctgctctgacagatggactgaccaaaagaatagtgtactttagttacggtaaccaacgagaacgccgacggaccacggccccgttgtacgttagtagtaattaataacgtaaagacctaacgtaggaacggaccggacccttacgaaggtacggtaccttaccccgttaggaaccggtacgtacgtttctaccgtcgggtcccttaccgaacggtccgtaaccggaacggggaaccacggtaccgtaacggttaccgtaaccggtttcgtaaacgtttacgtaacggtaacgggtttaacggaaaccggttacccggaaacgggtaaccggtaaacggggtaacgggaaaccgggtaacgggtaccgttaaacggttaaaccgtttaacgttaaaccgttacgtaaaacccggttaaaacgaaccgggtttaaaccggaaaccggttaaacggggttaaaaccgggttaacgggtttaaccgtttaacgggttaaacggggttttcggggggttaaccggggtttaacccggggggacccgggggtaaaaccgggtaacccggtaaaaaccgggttcccgggtttaaaccgggtaacccccggggttaacccggtttaaccggggtaaccccgtaaccccggggtaaaccccggtaaccgggtttacccccgggtacccccgggtccccccggtttaaccccgggg

SEQ ID NO: 201175 - DNA, 783 bp, Homo sapiens
  misc_feature: GYAE6OF01C7KN7.21.46.E02.1.454.CMB.1.raw
  modified_base (271)..(271): a, c, t, g, unknown or other
  misc_feature (271)..(271): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagccacctcggtgtcagtcgtccccaggaccaggacgccgaggtactcacctgctctgacagatggactgacctaaaagaatatgtactttaagtcggtaaccaanaggaacgcccgaaggacccgaacggccccttaggtacggttaagtgtaagtaagtaaactaaaaggacctaacgtaggacgaaccggtcccctaagaggaacgactaccccggtagacggcgttacttcgtactaggcctacgaagtcctacggaacgggaccaggtactaaacggttacccgtagtttacggaacttaagtcccgtaaaggtaggtaaaaccgttccggaacggaaccggaaagggtaaccgggaacggtacggttacggaaccgttaacgtttaacgtttaccgttaaacggtaacctaaaaccggtaaggttaacaaaccgggtaaggtaacggttaacggttaacctttaacggacgggttttaggggtaacgggtttaccgggacccgggggtaaaggtaaccggtaaacggtacggtaccggtaaccggttaaccggtaacggtaaccgtacgtaaaccccggtaggtccccgtaccggtaccccccgttaccggg

SEQ ID NO: 201176 - DNA, 602 bp, Homo sapiens
  misc_feature: GYAE6OF01EEO9C.21.46.E02.1.454.CMB.1.raw
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagaccggccaggatcacctgctctgcagatggactgaccaaaagtaatatgactttattggtaaccaacagaacgccaaggccacggcccctgtgttagtagatataataaagacagtgagacgcctnaganactccgtgacgacgtattctcgtaggcctccagtctacggacggacacgacgagtacacgttagactatcgagtagaacgtcgaggacaggacgacggacgtctagtaactcgttaactagtacgaaacgtacggtaagaaccgaaggttagtaacggtacttacgtaggtttgggtagttccgggagggaaccgggtaactacgggccgtacggtacccggttcgtaacggtccgaacggtacccgaagggcccgttccggacccccgttccggg

SEQ ID NO: 201177 - DNA, 624 bp, Homo sapiens
  misc_feature: GYAE6OF01DBGDA.21.46.E02.1.454.CMB.1.raw
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggacggccaggatcacctgctctgcagatggactgaccaaaagaaatntgattagttggtaaccaanagaacgccgaggccacggcccctgtcgttagtgaatataataagacactgagacgcctacgagagactcccgtgagcgtattccgtcgtcggccttccgacgtccgtacgacggggaccagcgtagttaccgtacgttcgacttagccgtaagtgaacgtccgaaggacgaaggcggaacggacggtctaggtaacttagtttacgtacgtaacgaaacgtagtaacggtaacgtaggttacggaggttacttacgtaggtttagggtcggttacggggaccgggtaagggaacctaggacgttacggacccgttcgtaaggtccgacggacccggaggtcccgtccggtccccgttacgg

SEQ ID NO: 201178 - DNA, 498 bp, Homo sapiens
  misc_feature: GYAE6OF01B4D5Z.21.46.E02.1.454.CMB.1.raw
  modified_base (312)..(312): a, c, t, g, unknown or other
  misc_feature (312)..(312): n is a, c, g, or t
  modified_base (412)..(412): a, c, t, g, unknown or other
  misc_feature (412)..(412): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgatctctggctcagctcagggacagcagcagttgactatcagtgaagtccaggcagaggacgaggctgactattactgtacaaacngtaagacagtaagaggtactcagttgggtgttcggcgggaggacccgaagctgccgtctaggtcacgcccaaggctgccccgtcgg

SEQ ID NO: 201179 - DNA, 660 bp, Homo sapiens
  misc_feature: GYAE6OF01EHSNF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaaagaatatgacttagttaggtaaccaacgagaacgccgaggaccacggtcccctggtgttagtagatataataaaagactacgtgaagacggacccctagaagagtactccgtaggaagtccgtaattccgtcgtggcccttaccgagccgtacggacgggtaccaaggccgtaagtaccgtaacggttgaaccttacgtcgtaaggttacgaacgttacccgaagggacgaagggaacgggacgggtaacgggtacgttagtaacgtacttaacgtacgtaaccaaagagttaacgaacgtaggtacggtaggttactactagggttgggttacggttacgggacgggtaacggaacgtacgtcgttacggacccggttacgtacggacctacggacccaagggtccctcccggccccgttaccgg

SEQ ID NO: 201180 - DNA, 712 bp, Homo sapiens
  misc_feature: GYAE6OF01BJCBZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggactcacctgctctgcagatggactgaccaaaagaatatgtacttagttaggtaaccaacaagaacgccgaaggcccaacggtcccctaggttacgttagtagaataataataaagactactagagacggtccctagagagactcccgtagacgcgtacttcgtcgtcggtcctaccgagtcctacggaacgggacgacgtacgacggtacgtacggttaccgtaacttactaccgtaagttacggtaaacgttccggaacggtacggaacggaacgggacggaggtaccgtacggtaactttaacgttacgttaaggtaaccaaaacgtaggtaacgtaagtaacgggttacgaaggtttacctaggttacggtttgggtacggttaccggggacgggtaaacggggtacctaacggtaccgttacgggtacccggttaccggttaccgggaccgtaaccggaccccgtaaacggtcccgtcccccggtcccccggtacccgg

SEQ ID NO: 201181 - DNA, 619 bp, Homo sapiens
  misc_feature: GYAE6OF01DY5II.21.46.E02.1.454.CMB.1.raw
  modified_base (243)..(243): a, c, t, g, unknown or other
  misc_feature (243)..(243): n is a, c, g, or t
  modified_base (397)..(397): a, c, t, g, unknown or other
  misc_feature (397)..(397): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatntgtcttattacggtaaccaaacagaagccaggccacggcccctgtgttagtgatataataaagacactggagacggccctagagagactcccgtgacgcgtactttccgtcgtggcctccgagtctacgagggacagacacggtacacggttanaacttatacgtagttacgaacgtacccgaggacaaggacggacggaggtactagtaactttaacttactacgtaacaaacgtagtaacggaactaagggtaagtaaggttactacgtaggttcgggttacggttcgggacgggtacgggaaccgagtcgttaccggaccgtaccgtaggacccgacgacccggtaaggcccgtcccggtcccccgttaccgg

SEQ ID NO: 201182 - DNA, 634 bp, Homo sapiens
  misc_feature: GYAE6OF01A39O2.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccgaggacagacggccaggatcacctgctctgcagatggactcgacaaagaatatgtacttagttggtaccaaacgagaacgccgaaggccaggccccgtgtgttagtgatatataaagacactaggagcgtccctacaggacgactccgtagagtcgtattcctcgtcggcctaccgacgctcgaacgggacacgcgacgtcgacggttagaaccttagtacgtagtacggtaacgtacccggaaggacggaaggaacggacgggaggtctaacggtactaagttaccgtacgtaacgtaaacgtggaagtacgtaaggtaggtaacgttacgtacgtaggttcggggttggtacggggtacgggaacggaacgtacggcgtacggtcccgtacggtacggtaccgaccgaccggaaggtcccgtacccgcccccggttaccgg

SEQ ID NO: 201183 - DNA, 724 bp, Homo sapiens
  misc_feature: GYAE6OF01EWB7P.21.46.E02.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctctatgagctgacacacgcccaccctcggtgtcagtcgtcccaggacagacggcaggactccactgctntgcagatcggactacgaaccaaaagtaattagtgttacttagttacggtaaccaaacgaaggaacacccgacggacccgaccgggtccccttaggttacggtttaggtagtaatttaacgtaaacgttaaaacggaccaacggttacggaacgggaccggtaccctagaacggtacgtaaccttcccgtaggaacgtacgttactttccgtcgtcggtacctacgtccgtactacggacggtacgacgtacggtacgtaccgtagtttacgactagtcgtagtacggtaacgtcggaaggaacggaagggacggacgtacgggtctaacggtaacttacgttacgtacgtaaccaagtaacgtaacggtaacgtacggtaagttaccggttaccaggtttacgggttggggttaacggttcggggaccgggtaaacgggtacgacggtaccgtcggtaccgttacggtacgaccgtaccgaccggtacgccgtcccgtccccggttacg

SEQ ID NO: 201184 - DNA, 555 bp, Homo sapiens
  misc_feature: GYAE6OF01DQ9UP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgacttattggtaaccaacagaagccaggccaggccccctgtcgttagtgatataataaagacacgtagagacggccctacagagactccctgagcgattctctggctccagctcgaggacagcagtcacgttgacttatcaagtgaacgtccaggacaaggacggacgaggtctagacttattactgtaacaacaagtagaacgtagtagagttatacgtagttgggtagttacgggcggagggaccgaaggcgtacggtacccgtaccgtacggtacacggacccgaaggcctccggtcccccgtaccgg

SEQ ID NO: 201185 - DNA, 633 bp, Homo sapiens
  misc_feature: GYAE6OF01BHYYP.21.46.E02.1.454.CMB.1.raw
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (385)..(385): a, c, t, g, unknown or other
  misc_feature (385)..(385): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaagaaatatgtcttattaggtaaccaacagaacgccaggccacggccctgttggttagtgatataanaaagacactgagcggtcccnagatactcccgtgacgcgtattcgtctggcctcgagtctagaggacacgcagtcacgttgactanacagtagaacgccaggcgagaggacgtaggctgtaacttagttacgtactaacgtaaagagttaagaacgtaaggttaacggtaacggttacttaccggttaagggtttcgggtacgggtttaccgggaccggggtaaacgggtacccgtaacggtaccggtacggtaaaccggttacccgtaacggtaaccggacccgggttaccccgaaagggttccccgtacccgggttccccccgtacccgggg

SEQ ID NO: 201186 - DNA, 676 bp, Homo sapiens
  misc_feature: GYAE6OF01BVHQZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgactttattacggtaaccaaacaagaacgacccgagggcccacggtccccctaggttacggttaaggtggtaattaagtaataaaagacctacgtaggaggacggccctagaagagactcccgtggacgcgtattctcgtcggcctccgagtcctacgagggacagcacgtctacgttcgaactactacgtaagtagtaacgtccgaggacgaaggacggacgaggtctacggtaacttacgttaacgtagtaaccgaaacgtaagtaagaacgtaaggtaaggtacggttaaccttacggtacggtttggggtacggttacggggacgggtaaccgggtaaccgaacggtccgtaccggacccggttaccgttaacgggtacccgacgggtaccccggaacgggtcccgtcccggtcccccggttacccgg

SEQ ID NO: 201187 - DNA, 560 bp, Homo sapiens
  misc_feature: GYAE6OF01D2N8M.21.46.E02.1.454.CMB.1.raw
  modified_base (244)..(244): a, c, t, g, unknown or other
  misc_feature (244)..(244): n is a, c, g, or t
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctgcagatggactgaccaaaagaaatntgcttattggtaaccaacagaagccaggccaggcccctgtgttagtgatataataaagacactagagaggccctnagagactccctagacgcgtattctacgtcggctcgagctcgaagggacagctagtctacgttgacttatcagtagaagtccgaggcaagaggacgaggctagtactagttactagtacaagagtaagacagtagtacgttactgtagttgggtacgttcgggacgggacgggaacgaggtcgtacggtacccgtaccgtaggtaccgacgaccccgaaggtccctccggcccccgttacgg

SEQ ID NO: 201188 - DNA, 654 bp, Homo sapiens
  misc_feature: GYAE6OF01DRMPY.21.46.E02.1.454.CMB.1.raw
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatcggactcgacaaagaatatgcttattggtaaccaacaagaagccgaggccacggcccctgtacgttagtgaatataataaagacacgtgagacggccctagacganctacccngacgcgtatttctcgtacggcctaccagcgtcgaacgggacacggcagtcacgttacgacttatcgaaggtagaacgtccgaggacgaaggacggacgaacggtctagtacttaacgttactacgtaacaaacgtaacgtaacgaacgtaagggttaaggaacggtacttacggtaggtttggggttacggtttcggggacgggtaacggggaacccgtaaaggtaccggtacggttaaccccggtaccggttaacgggtacccgaccggtaaccccggagggttacccgtcccccggtcccccggtttaacccggg

SEQ ID NO: 201189 - DNA, 571 bp, Homo sapiens
  misc_feature: GYAE6OF01EOG6T.21.46.E02.1.454.CMB.1.raw
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (372)..(372): a, c, t, g, unknown or other
  misc_feature (372)..(372): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctcggtgtcagtgtccccaggacagacggccaggatcacctgctctgcagatggactgccaaaagaaatatgcttatggtaccaacagaagccaggccaggcccctgtgttagtgatataataaagacacgtgagacggccctnagagtanccctgacgcgattcncgtcggctcagctcgaggacagcaagtcacgttnactatcagtgaagtccaggcaggaggacgaggctagacttattacgtagtacaaagtgtaacgacgtaagtaagtaggttactacgtagttcggggtggttaccgggacgggtaacggaccgtaacgtcgtacggacccggttccgtaacgggtccgaaccggacccgaaagggcccttcccggaccccccgttacggg

SEQ ID NO: 201190 - DNA, 675 bp, Homo sapiens
  misc_feature: GYAE6OF01DBRO4.21.46.E02.1.454.CMB.1.raw
  modified_base (222)..(222): a, c, t, g, unknown or other
  misc_feature (222)..(222): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (355)..(355): a, c, t, g, unknown or other
  misc_feature (355)..(355): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacagccaccctcggtgtcagtcgtcccaggacagacggccaggatcacctgctctgcagntggactgacaaaaganatgtactatggtaaccaanagaacgccaggaccacgtccctgtcgtagtagatataagtaaacactagtagacgacggtcccagaacggtagtactcccgtagacgtcgaactttcncgtggcctaccgacgtcgtcgaagggacagctagtacgtacgttacgacttacacgtagtacgaacgttccgaacggagaacggaggaaccgaggtacctaggtaacttagttaaccgtagtaacgaaaacgttacggtaacgtaaccggtaaggttaacgtaacggtttaccgttaacggttagggtttacggggttacgggttaccggggaaccgggtaacgggtaaccgtaaaccggtcggttaccggacccggtttaccggagggtacccgtaccggtaccgaaacggtcccgttaacccggcccccggttaccgg

SEQ ID NO: 201191 - DNA, 729 bp, Homo sapiens
  misc_feature: GYAE6OF01CLFNO.21.46.E02.1.454.CMB.1.raw
  modified_base (144)..(144): a, c, t, g, unknown or other
  misc_feature (144)..(144): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (708)..(708): a, c, t, g, unknown or other
  misc_feature (708)..(708): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctcngacgcctcctatgagctgacacgacgcccacccgtcggtgtacagtccgtaccccgaaggaccacggaccggaccgaagggactcctaccgtgccttcgtgacaagtagtacggaacacgaaaccaaaagaaattntcggtacttagtacgtaaccaanagaacgacgacggccgacgccgtagtgttagagtaatataaagtaaacgacgacgtaggaacggaccgtaccaacgtaacggaactcccgtaccggtagacgtacgtacttccgttacggtcgtcctacgacgtaccgtaggaacgggtaccaggtcgtacgtacgtacgtacgtacgtaagtaccgaaggtacgtaacgaccgaacgggagaacggacggtacggaacggtactaacgtacgttacgtataacgaaacgtaacgtagaacgtacgtaaggacgttagtactacgttagggtacgggttacggtaccgggaggtaaccgggaaccgtaacgggtagtaacccggtaccggttaccgtaaccgggtaccgaacccgggaaccgacccgggttcccncccccggtttcccggtaccgg

SEQ ID NO: 201192 - DNA, 596 bp, Homo sapiens
  misc_feature: GYAE6OF01BK4F3.21.46.E02.1.454.CMB.1.raw
  modified_base (290)..(290): a, c, t, g, unknown or other
  misc_feature (290)..(290): n is a, c, g, or t
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctcggtgtcagtgtccccaggacagacggccaggatcacctgctctgcagatggactgaccaaaagaatatgacttattggtaaccaacagaagccaggccacggcccctgtgttagngatataataaagacactgagacggccctnagagactccctgacgcgtattcgtctggcctccgagtctacgaaggggacaggcacgtcacgttgtaactagtctaaggtacgaaacgttccgaggacgaaggacggacgaaggtctaggtaacttacgttacgtacgtaacaaacgtaagtagaacgtaagtaggtacggttaactcgttaggttgggttacgtccgggagggtacgggacctaaggtcctacgggtaccgtacgtacgggacacggacccgaaggccttcccggccccgttacgg

SEQ ID NO: 201193 - DNA, 770 bp, Homo sapiens
  misc_feature: GYAE6OF01CR3RQ.21.46.E02.1.454.CMB.1.raw
  modified_base (177)..(177): a, c, t, g, unknown or other
  misc_feature (177)..(177): n is a, c, g, or t
  modified_base (223)..(223): a, c, t, g, unknown or other
  misc_feature (223)..(223): n is a, c, g, or t
  modified_base (326)..(326): a, c, t, g, unknown or other
  misc_feature (326)..(326): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacagccacctggtntcgagtcgtcccaggacacggacggccaggtactccacgtgcttcngcagagtcggactcggaaccaaaaggaattagtacgtactttagttacggaaccaacgaagaaaccgccgaacggccgacggtcccttaggttacgttagtanaagtttaagtaaagttaacgactacgttaggaacggtaaccgccctaagaaggtaacgtacctaccgtagacggtccttaactttccgtaacgttccgaccttaccggagtaccgtaggaacgggtaacacggtactacggttaccgtacggttactaccgttagtaacggacggtttaaccggaacgtaacccggacggaacggaacgggttaacgggaaccggtggtaaccgttaacggtaactttaacggttttaacaacgggttaaaacccaaagggtacgtaacggtacgtaaagggttaacgtaacggtactacggttaagggttcgggttacggtaccgggacggggttaacgaaccggtgtaccggtacggtacccgtacggtaccggtaaccacccggacggtaaccggtccctccccgggtacccgttacccgg

SEQ ID NO: 201194 - DNA, 996 bp, Homo sapiens
  misc_feature: GYAE6OF01A9IFP.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctcccctcctcactctctgcacaggctctggagcctcctatgagctgacacagcccaccctcggtgtcagtccgtcccgaggacacggaccggccaggactccacctgcctcgtcgacgagagtcggacctacggaaccaaaagtaaattgtacgtactttaagttaccggtaaccaaaacgacggaaaccgacccgaacgggcccgaaccgggtcccccgttaggtttaggttaacggtacggtaattaacgttaaacgtaaaaacggaacctaacggttagggaaacggtaaccgggtaccccccttaggaaacggtaaggtaccccgttaccccgtaagggaccggtaccggttaactttccgttcccgtacgggtaccccgtaccgtaccggtacccgttacgggaaccggggtaacccgtaacgggtacccgttaacgtttaacccggttacggtttaaccggaaccgtttaccgttaacccgtaaggggttaaccggtaaacgggttaccccggaaacgggtaccgggtaaacgggaaccggggtaaccgggtacgggtacccgttaaacgggttaacctttaaaccgtttaacgttaaccggttaaacctaaaaacggtacgggtaaacggtaaccgttaacggggttaaacgggtttaaccgggttaaaccgttttaaccggtaaggggttttacggggtttacgggggtttacccgggaaacccggggggtaaacgggtaaaccccggtaaacggttccggttaaccccggggtaaaccccggttaaccgggttacccgggtaacccggtaaacccgggaccccccgggttaaagggttcccctccccgggtcccccccgttttaacccgggg

SEQ ID NO: 201195 - DNA, 663 bp, Homo sapiens
  misc_feature: GYAE6OF01ED67N.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctgcagatggactgaccaaaagaaatatgactttaattcggtaaccaacgaagaacgccgaggccacggcccctgttcgttagtgaataataataaaacgacacgtaggacgtacggccctagaaggacgtactcccgtgacggcgtaactttcgtcgtacggcctccgagcctacgaacgggacgacgcgaagttccgtaacgttaggtaaccttagttacgaaggttacgaaacgttaccgaagggacgaaaggaacgggacggagggtactagaactttaacttacttacgtaacaaacgaagtaacgaacgaggttaaggtaacggttaactacgtaggtttacgggttacgggttacgggacgggaacgggtaccgaaacggttcgtacggtacccgtacgtacggtacaccggaccgaaggtccgtccgcccccggttacgg

SEQ ID NO: 201196 - DNA, 809 bp, Homo sapiens
  misc_feature: GYAE6OF01DYQXC.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcacctctctgcacaggctctgaggcctcctatgagctgacacacgcccacccgtggtgtcagtcgtccccaggacaggacggccaggatccacctgctctgcagatggactgaaccaaagaatntgtacttattcggtaaccaacagaacgccaggccacgcccctgtagtagtagaatataataaacgacacgtaggacgacggccctagagacgctaccgtagacgtacgtactttccgacgtcggtcctaccgtacgtaccgtacggaacgggacgacgtaccgtaacgttaccgtaacggttacgtaacgttaacgtacgtaaaggttacggtaaaccggttcccgaaacgggacgtaaacgggaaccgggtacgggtaacggtaccgttaacggtaacctttaacgtttaccgttaacggtaaaccgtaaaccgtaaagggtaacggtaaaccgtaagggtttaacggttaaaccgggttacgttaaccggttagggtttacgggggtttaccggggttaccgggggaccgggggtaaacccgggtaaacccggtaaaccgggttacccggttacccgggttaacccccggttacccgggttaacgggaaccccgtaacccggtaaccccgggtacccggtccccggttacccccgggttccccccgggttaacccccggg

SEQ ID NO: 201197 - DNA, 685 bp, Homo sapiens
  misc_feature: GYAE6OF01BL6Q3.21.46.E02.1.454.CMB.1.raw
tcagtcgtcgctcgcacgaccggtgctcgatttagactcatctacagggaaagggggtgggcccaggaggcagaactctgggtgtctcaccatggcctggatccctctacttctccccctcctcactctctgcacaggctctgaggcctcctatgagctgacacagccaccctcggtgtcagtgtccccaggacagacggccaggatccacctgctcgtgcagatggactgaccaaaagaaatatgtcttattggtaaccaacaagaagccaggccaggccccctagtgttcggtcatccatggacggacgagggagaccggaccccgtccgggactccccgtgagagacttctcgtcggctaccaacgtcgagggaacggtcggacctacggtttgattcgtcgtagggtcggggacccgtagggtagggagggtagtaggaacgcgtaggtaaccttaacgttacgttagttaaccgtcgtaagtccgaacggactaaggacgtaggttacgggtcctaagtccgggtaaggggggtcctaacgggttacggggaccggggaacggggtacgtacgggtttaccggacccggtttaccgtacggggtccgaacggtccccggaaagggtccccgtaccggtcccccccgttaccggtccctaaccggttccgttaccccccgg

SEQ ID NO: 201198 - DNA, 790 bp, Homo sapiens
  misc_feature: GYAE6OF01BSZI6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacacgccctacccgtcggtgtccaggtcgtaccccgaggacacggaccggaccgaggtactccaccgtgctcgtgcgagtagtggactacgaaccaaaaggaaattatggttacttacgttacggtaaacccaagaacggaacggaccgtacgggacccgtaaccgggccccgtttaggtaggttttaaggtaggtaatttaataaaacgttaaaacgactaaccggtaggaacgggtaccggtaccccaggtaacgacggaccttcccgaggacgacgttactttccgtcgtagggtaccctaccgcggaccgttaacggaacgggtaaccgacggtacgttaccggttaccgttacgggttacttaacgtacggtacgtaaggtacgggtaaccggttacgaaccggggagaaacggggacgggaaccggaacggtcgtaaacgtcgtttaagttaccggtaagtaacctaaaggtacggaagttaacggaggtttaagggaccgtttagtacgggtagtttgggtacggttacggggacggtaacgggacgacgtcggttaccgggtcccgtaagtaccggggtcaccgggtacccgaacgcccggttcccggcccgttaccgg

SEQ ID NO: 201199 - DNA, 637 bp, Homo sapiens
  misc_feature: GYAE6OF01CA6Q7.21.46.E02.1.454.CMB.1.raw
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtcgtccccaggaccagacggccaggatccacctgctctgcagatggactgaccaaaagaaatntgacttagttcggtaaccaacagaacgccgaggccacggcccctgtgttagngataataataaagacacgtggagacggccctagaagagactcccgtagacgcgtattctcgtggcctcgagtctacgagggacagcagtcgtacgttgacttagtacgagtagaacgtccgaggacaaggacgggacgaggtacgtagtacttattacgtagtaaaccaaacgtagtaagaacgtaggtaacggtaagttactagttaggtttggggtacgttcggggacgggtaacggaaccgtaacggtccgtaaccgggtacccggttaccgtaacgggtacccgtaaccggaccccggttaaggtccccgtcccggtccccccggttacccggg

SEQ ID NO: 201200 - DNA, 760 bp, Homo sapiens
  misc_feature: GYAE6OF01BW2NW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactcgaccaaaagaaatatgtcttagttaggtaaccaaacagaacgccaggccacggcccctgtcgttagtgatataataaagacacgtgagacggccctgagagtactcccgtaggacgcgtattcgtcgtcgggaccttccgacgtccgtaccggaacggggaccacggacgtaacggttaccgtaaccggtttacgaaccttacgttacgtaacggttaacggtaaacggttcccggaacgggtacgaaacgggaacgggaacggaacgggtacctacggtaacgtttactttaaccgttacgtaaaccgtaaaacgtaaggtaaacgtaacgtaaaggggttaacggtaacgggtttaaccgttacggtaagggttttgggggttaccgggtttaccgggggaaccggggtaaccgggggtaacccgaaccgggtcggttaacccgggtaccccgggttacccgtaacgggttaccgtaaccgggtaccccgaaacgggtcccgtaccccggtccccccggttacccggg

SEQ ID NO: 201201 - DNA, 560 bp, Homo sapiens
  misc_feature: GYAE6OF01AOAOM.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgacttattggtaaccaacaagaagccaggccaggcccctgtgttagtgatataataaagacactgagaggccctanagagactccctgagcgattcctacgtggcctccagctagagggacagcagtcacgttgactagtcaggtgtaacgtccgaggcaaggaggacgaggctaggtaactagtttacctagtaccaaacgagtaacgacgaagtagaacggttactcgtagttgggtagtcgggacggagggaaccaggtctggacccgttcgtacggtacacggacccaagggtcctccggtcccccgtaccgg

SEQ ID NO: 201202 - DNA, 837 bp, Homo sapiens
  misc_feature: GYAE6OF01DP0CM.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacagcccacccgtggtgtcagtcgtccccaggacacgacggccaggactcacctgctctgcagatggactacgaccaaaagaatntgtactttagttacggtaaccaaacgaaggaacgccgtacggaccgacggccccttaggttacggttaaggtgtaatttaacgttaaagtaaaacggaactacgtaggaaggtaccggtcccagaagacgtaccgtcccgtagacgtacgtactttcgtcgtcgtaccttacgacgacctacggaacggggaccacggaccgttaacggtaccgttaacggtttacggtaacttacgttacggtaacggttacggtaaaccggttacccggaagggaaccgaaacggggaacgggtaaccgggtaaggtaccgttaagggttaaacctttaacgtttaacccgttaaggtaaacccaaaaaggttcggtaaaacggtccggtaaacgggttaacgggttaaacggttacccgtttagggtttaaagggtttcgggggtttaaccgggtacgggggtaacccggggtaaacggtaacccggtaacgggttcccggttaaccggtacccgggtttaccggtaaccgggttaccggaaccgggttaaccccggaaaggttcccccgtaacccgggttcccccgtttacccggg

SEQ ID NO: 201203 - DNA, 566 bp, Homo sapiens
  misc_feature: GYAE6OF01B8KC9.21.46.E02.1.454.CMB.1.raw
  modified_base (287)..(287): a, c, t, g, unknown or other
  misc_feature (287)..(287): n is a, c, g, or t
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattaggtaccaacagaagccaggccaggcccctgtgttagngatataataaagacactgagacggccctnagagactccctgagcgattctcgtcggctccacgctacgagggacacgcagtcgagttgactatcgagtagaagtccaggacaaggaggacgaggctaggacttagttactagtaacgaaactaagtaacgaacgaggttaaggaggttaactcgtagttgggttcggtacgggcgggaaggtaccgaggcgtacgtacccggtcgtaggtccacggtaccccgaaggtcccgtccgtcccccgtaccgg

SEQ ID NO: 201204 - DNA, 540 bp, Homo sapiens
  misc_feature: GYAE6OF01ELZHN.21.46.E02.1.454.CMB.1.raw
  modified_base (377)..(377): a, c, t, g, unknown or other
  misc_feature (377)..(377): n is a, c, g, or t
  modified_base (406)..(406): a, c, t, g, unknown or other
  misc_feature (406)..(406): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgccaaagaatatgcttattggtaccaacagaagccaggccaggcccctgtcgttagtgatatataaagacactgagacggccctcgagagattccccgtagacgcgtattctcgtggcttccgagcctcgagggaccagcagtcacgttnactatcagtagaagtcaggcaggagacgngctgactattatgtacaaacgagtaagacgtagtagagttactcgagttgggtgttcgggcggtagggaccaaggtctaggtacccgtccgttagggcctacggacccaagggtcctccggcccccgttacggg

SEQ ID NO: 201205 - DNA, 711 bp, Homo sapiens
  misc_feature: GYAE6OF01B5SV8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagccaccctggtgtcagtcgtccccaggacagacggccaggatcacctgctctgcagatggactagaaccaaaagtaaatagtagtactttaagttacggtaaccaaacgaaggaaacgacccgaacgggacccgaacgggtcccccgttaggttacggttaaggtagtaaattaataaagtaaaacggaacctaacgtaggaggaccgaccctacgaagacgactcccgtagacgtccgttaattcgtacgtggaccttccgacggtacctacggaacgggtaaccacggtacgtaacggttccgtaacggtttacgaacttaacgtacgtaagggtacgaaacgtccgaggacgaaggaggacggtagctaggtaacttagtactagtaacaaacgacggtaagtacgaagtacggtaacgttactacgtaggttcgggttaggtaccgggtaacgggacggaacgtacggtacgttaaccgggccgttaccgtaacgggtaccgaccggtacccggaaggtcccgtcccggccccgttacccgg

SEQ ID NO: 201206 - DNA, 616 bp, Homo sapiens
  misc_feature: GYAE6OF01BEP2R.21.46.E02.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtntcagtgtccccaggacagacggccaggatcacctgctctgcagatggactgaccaaaagaaatatggtacttattcggtaaccaaacaacgaaacgccaaggccaacggtccccttggtacgttagtgaattataataaagacacgtagagaggccatcaagagacttccctagagcgtatttcctacgttggcctccgagtcgtacgagggacacgctacggtacgtacgttacgaacttactacgtagtacgtaacgtaccgagggaccgaaggacgggaaccggaaggtcgtacgtaacttacgttactacgtacaaacgagtacgaacgtaagtagacgtatcgttaggttgggtacgttcgggaacggacgggaaccaaggtcgtacggtaccgtacgtacggtcacggacccgacggtccgtccgtacccccg

SEQ ID NO: 201207 - DNA, 759 bp, Homo sapiens
  misc_feature: GYAE6OF01BM1LM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcaggtcgtccccaggacagacggccaggactccacctgctctgcagatggactgaccaaaagaatatgtacttagttacggtaaccaacgagaacgccgacggaccacggtcccctggttacggttacgtagtaataagtaataaaacggactaaccgtaggaacgacgggtacccctacgaacggaacgtaccgttaccccgtaggtaaccggtaccgttaacgtttccgttcgttcgggtacccttacccgacgtaccgtacggaacgggaacgacgtacgtacgttaccgttacggttacggtaaccttagtacgtaacggttaacgaacgttcccggaaacgggtacgaagggaacgggacgtaggtacgtacggtaacttagtttacgaacgtaaccgaaacgtaacggaagtaaccgtaagggtacgtaacgttactacgttacgggtagggttacggttaccgggacgggtaaccgggaaacgtaccggtacggtaccggtccccgttaagggttaccggaaccgtccgtaaccccgggacggtccccgttcccggtaaccccggttcccgg

SEQ ID NO: 201208 - DNA, 1041 bp, Homo sapiens
  misc_feature: GYAE6OF01BM7XZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagcccaccctcggtgtcagtcgtccccaggacagacggccaggactcacctgctctgcagatggacctagaaccaaagtaaagtatcgtactttagttacggtaaacctaacgaacgaaacgacccgaacgggacccgaccgggtaccccccttaggttaggtttaacggtaggtaaatttaacttaaaacgttaaaaacggtaaccgtaacggttaacggaacgggtaaccgggtacccccttacgaaacgggtaacgtaaccgtttacccccgtagggtaaccggtaccgttaacgttttccgtaccgggtaacggggtccccttaaccgaaccgggtcccgttaaccggaaacgggggtaacccgtaacggtacccggtaaacggttacccggttaaccggttttacggtaaacccgtttaaccggttaaccggtaaacgggtttaacgggtaaacccgtttaccccgggaaaacgggtaccggaaacgggaaaccggggtaaaccgggaacgggttaacccgtttaacggggaaccctttttaaaccggttttaacccggtttaagggttaaaaccccgtaaaaacggttaaaccggggtttaaaccggtaaaccgggttaaaacgggttaaacgggtttaaaaccggggtttaacctttaaccggggttaacgggttttacggggggtttacccggggttttaaccggggggaccgggggtttaaaaccgggggtaaaccccggtaaacgggttcccggttaacccgggttaacccccggggttacggttaaacccggggtacccgtaaaccggggtacccccgtaaaaccgggttccccgtacccccgggttacccccccgggtttacccggg

SEQ ID NO: 201209 - DNA, 613 bp, Homo sapiens
  misc_feature: GYAE6OF01CPEKQ.21.46.E02.1.454.CMB.1.raw
  modified_base (242)..(242): a, c, t, g, unknown or other
  misc_feature (242)..(242): n is a, c, g, or t
  modified_base (319)..(319): a, c, t, g, unknown or other
  misc_feature (319)..(319): n is a, c, g, or t
  modified_base (394)..(394): a, c, t, g, unknown or other
  misc_feature (394)..(394): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacgccaggatcacctgctctgcagatggactgaccaaaagaaatntgcttattggtaaccaacagaagccaggccaggcccctgtgttagtgatataataaagacactagagacggccctanagaagactcccgtagagcgtaattctacgtcggctccgagtctacgagggacaggcagtactacgttgaacttancgtagtagaacgtacccgaggacgaaggacggacgaggactagtaacttagttactagtaacgaacgtaagtaagaacgtaagtaggtaacgttacttacgtaggttagggttcggttacgggaccgggaacgggaaccgtaaggtccgttacgggtacccgtacgttacggacccgaccggacccggtaacggtcccgtccgtccccccggttaccgg

SEQ ID NO: 201210 - DNA, 563 bp, Homo sapiens
  misc_feature: GYAE6OF01DVRKM.21.46.E02.1.454.CMB.1.raw
  modified_base (374)..(374): a, c, t, g, unknown or other
  misc_feature (374)..(374): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgactttattggtaccaacagaagccagccaggcccctgtgttagtgatatataaagacactgagaggccctgagagatccccgtgacgcgtattctcgtggcctccagctcgagggacagcagtcacgttnactatcgagtagaacgtccgaggactaggacggacgacggtctaggtacttagtttacgtagtaccaaacgtaagtaagaacgagttagacggttactacgtagtttgggtggttcggacgggagggaccgaaagtcgtacggtaccggtccgtaggacgacggacccgaggcctccgtcccccgtcgg

SEQ ID NO: 201211 - DNA, 777 bp, Homo sapiens
  misc_feature: GYAE6OF01EJNXQ.21.46.E02.1.454.CMB.1.raw
  modified_base (214)..(214): a, c, t, g, unknown or other
  misc_feature (214)..(214): n is a, c, g, or t
  modified_base (754)..(754): a, c, t, g, unknown or other
  misc_feature (754)..(754): n is a, c, g, or t
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgacggcctctatgagctgacacacgccaccgtcggtgtcagtcgcccaggacagacgcaggactcactgctcngcagagtcggactacgaactaaaagaatagtacgttacttagtaccggtaaccaacgacgaacgccgaacggccgaccggtccttaggttagttagtagtaattaaagtaaacgtaaacgactaggtaggaaccggtacccggtacctaagaacggtacgtacccgttaccgtagggtaaccgttaccgttaactttccgtacggttaccggtaccctaacccggtacggtacccgtaacgggaacggggtaaactacggtaccggttaacgttaccggtttaacggttacgttaactaacgttacggtagggtaacggtaaaccggtacgaacggaacgggtaacgggaacggacgggtacggttaactaccgttaaacgttaccgtttacgaacgtaaccgtaaagaggttaaacgaaggtaagggtaacgttacgtttaacgtcgggttaagggttcggggtacgggtaccgggacgggaaaccgtacgtacgggtacctaccggcggtttacgacggaccgtaccacgggttaccnccggttaccccgtacccggttcg

SEQ ID NO: 201212 - DNA, 725 bp, Homo sapiens
  misc_feature: GYAE6OF01B1C5E.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacccgtggtgtcagtcgtccccagggacagacggccaggatcacctgctctgcagatggactgaccaaaagaatgtgtacttagtaggtaaccaacagaacgccaggccacggccctgtgttagtgatagtaataagacacgtacgagacggcctagacgacgtactccgtggactcgtacttctcggtcggtctaccgtacgcgtacgaacggggtacacgtaccgtagttaccgagtttcgaaccttagtaccgtaggtaacgttaacggaccgtaaggaccggtaaggaaccggggtacgtaacgggtcgtaccgttaaaccgtttaagtttaaccgttaacggtaaactaaaccggtaaggttaacggtaacgtaaagggttaacgggttaacggttaacgttcggttaagggttacggggtttaccgggttacgggggaaccggggtaacgggtaacccgaaggttcccggtacggtaccccggttaccgttaacgggtaccgtaaccggacccgggtaggtaccccggttccccgtccccgggttacccgg

SEQ ID NO: 201213 - DNA, 528 bp, Homo sapiens
  misc_feature: GYAE6OF01BF17D.21.46.E02.1.454.CMB.1.raw
  modified_base (312)..(312): a, c, t, g, unknown or other
  misc_feature (312)..(312): n is a, c, g, or t
  modified_base (418)..(418): a, c, t, g, unknown or other
  misc_feature (418)..(418): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatcccctgagcgattctctggcctccagctcgagggacagcagtcacgttgactatcagtgaagtccaggcagaggacgaggctgactattactgtacaacngtagacagtagagtactgtagttgggtgtcgggacggacgggtaccaaggcgtcgtacccggtacgtaggtaccgacgaccccgaaaggccgttccggcccccgttccgg

SEQ ID NO: 201214 - DNA, 702 bp, Homo sapiens
  misc_feature: GYAE6OF01DFR3W.21.46.E02.1.454.CMB.1.raw
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagngtggactgaccgaaagaaatntgtcttagttaggtaaccaaacaaggaacgaccacggccacggccccctgtgttacgtgtaagtaataataaacgaactacgtagacggacggcccctacgaaggaagacgtaccccgtaggacgaccgaatttcgtccgtcgggtccctccgagtccgtcggaacgggaccgagcgtaacgtcgtaacggttgtaacctacttacgaacggtacgaacgttacccggaagggaccgtaaagggacgggtaccggaggtaccgttacgtaacttaacgttacgtagtaacaaacgaaggtaacgaacgtaggtaaggtagtacgttagtacggttggggtacggttaccgggacgggaacggtaacggaacggtcggttaccggtaaccgttaccggttacggtaccgaaccgtaaccccggtacgggtcccgtcccggttcccccggttaccggg

SEQ ID NO: 201215 - DNA, 761 bp, Homo sapiens
  misc_feature: GYAE6OF01EXI6C.21.46.E02.1.454.CMB.1.raw
  modified_base (294)..(294): a, c, t, g, unknown or other
  misc_feature (294)..(294): n is a, c, g, or t
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtctccccaggacagacgccaggatcacctgctctgcagatggactgacaaagaatatgcttatggtaccaacagaagccaggccaggcccctgtcgttagtgatagtaataanacgactggagacggccctnacgagacctccgtagacggactactttcctacgtcggtacctccacgtccgtacgaaggggacctaaggacgtacgttctaacgggtttagtacttaacgtaccgtaacggttaggaacgttcccgaagggaacgaacgggtaacggtaacgggacgggtaccgtacggtaaccgttagtttaaccgtcggttaaacctaaaacggtaggttaaacggtaacggtaaacgggtacgttaaacgggttaactacggttaacgggttttagggggttacggtttacccggggggtacggggtaaacccggggttaaacccgtaacgggacccggttttaacggtaaccccgggttaccccgttaccggggttaaacccggtacccgggtaacccccggtaaaccggggttcccggttacccccgggtccccccccggttttaacccgggg

SEQ ID NO: 201216 - DNA, 620 bp, Homo sapiens
  misc_feature: GYAE6OF01EFRNI.21.46.E02.1.454.CMB.1.raw
  modified_base (242)..(242): a, c, t, g, unknown or other
  misc_feature (242)..(242): n is a, c, g, or t
  modified_base (371)..(371): a, c, t, g, unknown or other
  misc_feature (371)..(371): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagccaccctcggtgtcagtcgtaccccaggacagacggccaggactcacctgctctgcagatggactgaccaaaagaatntgacttatacggtaaccaacagaacgccacggccacggtccctgtgttagtgaattataagtaaagacgtacgtagacggacggtccctgaagagtactccgtagacgtactattcgtctcggctaccngtctacgagggacagcacgtctacgtatactatccgtaagtagtaacgtccgtaaggactaaggacggacgtaggacgtagtaacgtatttacgacgtaacgaacgtagtaacgacgtaggtaacgtacgttactcgtaggttgggtacgtacgggacggacgggaaccgtagtccgtacggtaccccgttaacggtacggtacccgaccggtacccggtaaggtcccgttcccggtcccgttacccgg

SEQ ID NO: 201217 - DNA, 752 bp, Homo sapiens
  misc_feature: GYAE6OF01AQHZX.21.46.E02.1.454.CMB.1.raw
  modified_base (217)..(217): a, c, t, g, unknown or other
  misc_feature (217)..(217): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtcgtccccaggacaggacggccaggatcacctgctcngcagatggactaggaccaaaagtaaatatagtactttagttacggtaacccaaacgaggaacgaccgacggcccgaacggtcccctggttggttaagtagaatttaanaaacgtaaagacctacgtaggacgacggccctagaagacgtactcccgtagacgtacgtactttccgtacgtcggcctaccgacgtcgtacggaacggggtacaggtaccgtaagttaccgtaacgttacgtaactacgttacgaaggtacggtaaaccggtacgaagggaccgaaagggaacgggaacgggtacggtacgttaacggtaactttaacgttacttaacgtaaaccgaaacgtaacggttaacgaacggtaaggttaacggtaggtttaaccttacggttagggtttacggggttacgggtaccggggtaacggggaacgggtaaaccgtacggtaccggtaaccgggtacccggttaacggtaccggaccgtaccggtaccccggaagttcccccgtcccggtccccccggttacgg

SEQ ID NO: 201218 - DNA, 928 bp, Homo sapiens
  misc_feature: GYAE6OF01DBGJ9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctgcagatggactcgaccaaagaatagtgctttaagttcggtaaccaaacaagaacgccgaacggccgacggtcccctgttagttagtagtaattaactaataaaacggactaacgtacggacggtacggtccccttacgaaggaacgtaccctaccccggttaggacggtaccgttaacgttttcccgtccgggttacggtccccgttacccgtaacgggttcccttaaccgggaaccggggaccgaaacggtacccgttaacgggtttacccgtaaccgggttttacgtaaccctttaacggttacccgttaaaggggttaaccgggtaaacccgggtttacccggaaaccggggtaaaccggaaagggggaaccgggggtaaccgggtacggggttacccgtttaacggttaaacccgttttaacgttttaaccggttaacgttaaacccggaaaaacggtttaacgggttaaaccgggtaaaacgtttaaacggggttaaagggtaaaccgggtttaaccgtttaacggttaacgggggttttacggggtttaacgggggttacccggggtaaaccggggggtaaccgggtaaccggaaacgggttccgttaaccggggtaaccccgtttaccgggtaaacgggttacccggaacccggtaccccgggaacggttccccgtccccgggtaccccccggtttacccggg

SEQ ID NO: 201219 - DNA, 611 bp, Homo sapiens
  misc_feature: GYAE6OF01BR9DP.21.46.E02.1.454.CMB.1.raw
  modified_base (368)..(368): a, c, t, g, unknown or other
  misc_feature (368)..(368): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaagaaatatgcttattggtaaccaacagaagccaggccaggcccctgtcgttagtgatataataaagacacgtgagacggccctcagagactcccgtaggacgcgtattctcgtcggctccagctacgagggacngacgagtcgtacgttgacttatcgagtagaacgtcccgaggtacgagggaacgggacggacggtcgtacgtacttaagtttacgtacgtaacaaacgtaggtaacgaacgaaggttacggtaaggttacgttacgtaggtttacggggttggttacgggacgggacgggtaaccgaggtacgtacggtacccggtacgttacggaccgacgacccgaagggtccctccggtcccccgtaccgg

SEQ ID NO: 201220 - DNA, 632 bp, Homo sapiens
  misc_feature: GYAE6OF01AKLXH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttatggtaccaacagaagccaggccacggcccctgtcgttagtgatatataaagacactgagacggcctacagagactccctgacgcgattcgctggcctcgacgctcgaggacagcagtcgacgttacgactagtacgagtagaacgtcccaggtaccgaaggtacggacggaggcgtagtacgttacgttacgtaggtaacaaacgtaagtaacgaaccgtagggtaacggtaacggttacgtaccgttaaggtttcggggttacgggtttccgggaacggggtaacgggaaaccgtaacggtaccgttaccgggaacccgttacccgtaacgggttccgaaacggtaccccggaaggtacccgtcccggtcccccgttaccccgggg

SEQ ID NO: 201221 - DNA, 651 bp, Homo sapiens
  misc_feature: GYAE6OF01EKWR0.21.46.E02.1.454.CMB.1.raw
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtcccaggacagacggccaggactccacctgcctctgcagagtggaacttcgaccaaaagaatatgtactttagttacggtaaaccaacgaacggaacgacccgacggacccgaaccgggtcccccttaggttacggttaacggtagtaaatttaaacgttaaacggtaaaaaacgtaccgtaaacggttacggaaacggaccgggtacccctacgaaacggacggtaccttccccgtaggacgtaccgtactttcgtcgtcggtcctccacgctacggacggacagcacgtcgtacgtnactntacgagtacgaagtcgagcgaggaagacggagctagacttacgtactagtaacaacgtagaagtacgagtaagtacggttactagtaggttggtaggtcgggacgggacgacgtagtcgaccggtcctacgtgaccgacgtacgacgccctccgccccgtcgg

SEQ ID NO: 201222 - DNA, 657 bp, Homo sapiens
  misc_feature: GYAE6OF01CN771.21.46.E02.1.454.CMB.1.raw
  modified_base (253)..(253): a, c, t, g, unknown or other
  misc_feature (253)..(253): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacgccctcctatgagctgacacacgcccacccgtggtgtcagtcgtccccaggacagaccggccaggactcacctgctctgcagagtcggactcgaaccaaaagaaatntgtactttagttacggtaaccaacgaagaacgccgacggccgacggccccttggttcggttagtgtaataataagtaagactacgtagacggaccggccctacgagacgtacctcccgtagacgcgtattccgtacgtcgcctacgacgtccgtaggacggacacggacgtacgtacgtacgttagtacttagtacgtagtaacgacgtaccgaagaacgaggtacggacgtacggtctacgtacttacgttacgtacgtaaccgtaaagtaggtaagaacgtaagggtagaacgttacgttagtagggttgggtcggtcgggacggacggaacgtcggtcgtaccggtaccgtccggtaacggtccgaccgtacccggacgttcccgcccgtccccgttccgg

SEQ ID NO: 201223 - DNA, 599 bp, Homo sapiens
  misc_feature: GYAE6OF01DHFST.21.46.E02.1.454.CMB.1.raw
  modified_base (243)..(243): a, c, t, g, unknown or other
  misc_feature (243)..(243): n is a, c, g, or t
  modified_base (338)..(338): a, c, t, g, unknown or other
  misc_feature (338)..(338): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatntgacttattggtaaccaacagaagccaggccaggcccctgtgttagtgattataataaagacactagagacggccctagagagactacccgtgancgattctctggctccagctcgagggacagcagtcacgttgactatcagtagaacgtccgaggcaaggaggacgaggctacgacttattactagtacaaacgtaagtaacgacgaaggtaggaacggttacttacgtaggtttcggggttcgttacggggacgggaacggggaaccgaaacgggtccgtacggtaccccgttaccgttacgggtaccgacggaccccggaagggtacccgtcccggtccccccgttaccggg

SEQ ID NO: 201224 - DNA, 637 bp, Homo sapiens
  misc_feature: GYAE6OF01D3WX8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacagccaccctcggtgtcagtcgtccccaggacagacggccaggatcacctgctctgcagatggactgaccaaagaaatatcgtactttattcggtaaccaacaggaaacgccgacggccgacggccccctgttagttagtgaatataagtaaagacacgtgaggacggccctacgagagtactcccgtgacgcgtattctcgtgcctcagctacgaggacagctagtcacgttgactatctagtagaagtccgaaggacgaaggacggacggacggcgtacgtaacgttaacgttactacgtaacgtaaacgtaaggtaacgaacggtaaggttaagtaacgggttaacttaccgttaggtttggggttacgggttaccgggacggggtaacgggaaccgaacgtccggtacggtacccggtaccgtaggtaccgaccggacccgaagggcccgtaaccgtccccccgtaccggg

SEQ ID NO: 201225 - DNA, 609 bp, Homo sapiens
  misc_feature: GYAE6OF01BZH0P.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgacttattggtaccaacagaagccaggccaggcccctgtgttagtgatataataaagacactagagacggccctanagagtactcccgtagacgcgtattctctggcctccagtctacgagggacaggcacgtcacgttgactatcagtagaacgtccgaaggcaaggaggacgagctagtacttattacgagtaacaaacgagtaagaacgtaggtaacggtaggttaactcggttagttacggggttcggttaccgggtacgggaacggggtaacccgaaggtacccgttacggaccccggttaccgtaacgggtaccgaacggaccccggaaaggtccggttcccgccccccggttacccggg

SEQ ID NO: 201226 - DNA, 710 bp, Homo sapiens
  misc_feature: GYAE6OF01EL07A.21.46.E02.1.454.CMB.1.raw
  modified_base (224)..(224): a, c, t, g, unknown or other
  misc_feature (224)..(224): n is a, c, g, or t
  modified_base (514)..(514): a, c, t, g, unknown or other
  misc_feature (514)..(514): n is a, c, g, or t
  modified_base (526)..(526): a, c, t, g, unknown or other
  misc_feature (526)..(526): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggaggcctcctatgagctgacacagcccaccctggtgtcagtccgtcccaggacaggaccggccaggactcacctgcttcgngctagagtggactacgacaaaagtaaatgtcgtactttagttacggtaaccaaagagaacgccgaacggccgacggtccccttaggtagttacgtgaatataataaacgctatagacgacggtccctagacgtagtacgtccctaggaagtccgttacttccgtcgtacggtcctacgagtccgaacggacgggacacggtacgtacgtacgtacgttagacttacgacgtagtacggaacgtccgaaggtacgagggaacggtacgacggtattacgaatttaccgttnaacgtaacaagngttaaacgacggtaaggtaacggtaaccggttagttaccgtaaggggtttcccggttagggaccgggtaccgggtaacgggtaaccgtacggtaccgttacccggttaaccccggtagttaacccgggtacgacccccggttaccggtaaccggtccttaccccccggtccccggttaacccgg

SEQ ID NO: 201227 - DNA, 761 bp, Homo sapiens
  misc_feature: GYAE6OF01AWZND.21.46.E02.1.454.CMB.1.raw
  modified_base (355)..(355): a, c, t, g, unknown or other
  misc_feature (355)..(355): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacacgccacccgttcggtgtcagtcgtccccaggacagacggccaggatcacctgctctgcagatcggactcgaccaaaagtaactatcgtacttagttacggtaaccaagagtaacgccgacggaccgacggtcccctggtacgttagtcgtaataataagtaaacggaacacgttaggacgacggtccctanaacggtacgaccgtacccgtaggaaccgtcgtaactttccgtacgtcgtacctaccgtacgtcctacggaacgggtaccacgtacgtaacgtccgtaaggttacgtaacgtacgttacgtaggtaacgggtaaaccgttacccggaagggaccgaaagggtaacgggaaccgtagggtaccctaacggtaacgtttaacgtttaacgtacggtaaacccgtaaacgtaagggttaaccgaacgtaacggttaaggtaaccggtttactaccggttagggttttcggggttaacgtaccggggtaccgggaaccgggtaaccgtaacggtcgtaccggtaacccggttcgtaacggttacccgaaccggtacccggtaacggtccccgttccggtcccccgttacgg

SEQ ID NO: 201228 - DNA, 692 bp, Homo sapiens
  misc_feature: GYAE6OF01C85DT.21.46.E02.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacacgcccacctcggtntcagtcgtcccaggacacgacggccaggtactccacctgctctgcagagtcggactagaaccaaaaggaattagtcgtactttaagtttcggaaaccaacgaagaacgccgacgggaccacggccccttgttagttagtagaattactaaagtaaagacctaagtggaacggacgtacccttacgaagtacgacctacccgtggaacgtcgtaagttttccgacgttggccttaccgagtccgaggaacggtacacgtcgacgtacgtacgttgaactatacgagttagacgtccgaggacgaacggaggtaaccggagaccttagtaactttaacggttaactgtaaacgtaaacgtagttaaacgaccgtaaagggtacgtaacgtttaaccgtagttagggttccgggtagggtttaccggaaccgggtaacggaccgtaagggtacctacggtacccggttacggtagtacccgacggacccgtaagccccgttccgcccccgttacgg

SEQ ID NO: 201229 - DNA, 665 bp, Homo sapiens
  misc_feature: GYAE6OF01EK1I9.21.46.E02.1.454.CMB.1.raw
  modified_base (206)..(206): a, c, t, g, unknown or other
  misc_feature (206)..(206): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacagccaccctcggtgtcagtcgtccccaggacagacggccaggntcacctgctctgcagatggactgaccaaagtaaatatgactttagttacggtaaccaaacagaacgccacggccacggcccctgtgttagtagataataataaacgacacgtaggacgacggtccctagaagtacgactccccgagacgtcggtattccgtaccgtcggtcctacgacgtccgtacgagggacagccgagttacgtacgttagacttaagtacgaaggttacgaacggttcccgaagggaccgtaagggtacggaacggtcggtctacgtacgttaattaccgtacgtaacgaaacgtaagtaacgaacgtagggtaagtaacggttactacggtaggttcggggtaggttccgggacggggtaacggtaccgaacggtcgtaccggtaaccggtccgttaacggaccgtacggtaaccccgaggtccccgtacccggcccttacccgg

SEQ ID NO: 201230 - DNA, 610 bp, Homo sapiens
  misc_feature: GYAE6OF01EU5AT.21.46.E02.1.454.CMB.1.raw
  modified_base (310)..(310): a, c, t, g, unknown or other
  misc_feature (310)..(310): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggaccggccaggatcacctgctctgcagatggactgaccaaaagaatatgtcttattcggtaaccaaacagaagccgaggccacggcccctgtgttagtgataagtaataaaanggtacacgtggaccgtaggacccctcaagtacgagtccccgtggagttccgatttcgtccttcggacttccccaggcgtacaacggggactaaggtccaagggttccaacgtttgaccttaagtcgaaggttcgaaaggtcccagggcgaaggagggacgaggacctagtaacttagttaaccagtacaaacagtagaacgtagtagtagtacttggagttggggagttcgggaacgaggtaccaaggcctaggaccgtcacggtaccaacggcccgaacggtccccgtggtaccccccg

SEQ ID NO: 201231 - DNA, 644 bp, Homo sapiens
  misc_feature: GYAE6OF01EM1ZO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgcagatggactgacaaaagaatatgcttattacggtaaccaacgaagaacgccgacggccacggtcccctgtagttagtagattaataagtaaacgacacgtaggaagaccggtccctagaggacgtacttccccgtaggacgtcgtactttctcgtcggcctaccgagtcctacggacggggacacggcaagttaccacggtttagtactactacgaaggttagaacgttaccgagggtacgaaggaacgggacgaggtctagtaacttacgttacgtacgtaacaacgagtaacgaacgtaaggtagtaacgttacgtagtaaggtttgggtacggttcgggcggaaagggaccgaacgtcgtacggtacccgttacgtacggaccgtaacggacccgaaggtcccgtaccgcccccggttacg

SEQ ID NO: 201232 - DNA, 528 bp, Homo sapiens
  misc_feature: GYAE6OF01EQAXP.21.46.E02.1.454.CMB.1.raw
  modified_base (178)..(178): a, c, t, g, unknown or other
  misc_feature (178)..(178): n is a, c, g, or t
  modified_base (315)..(315): a, c, t, g, unknown or other
  misc_feature (315)..(315): n is a, c, g, or t
  modified_base (432)..(432): a, c, t, g, unknown or other
  misc_feature (432)..(432): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctctgcagatggactgaccaaagaaatatgcttattggtaccaacagaagccaggccaggcccctgtgttagtgatatataaagacacgtgagaggccctanagagactcccctgagcgtattcctcgtggcctccgagctgagggacagcagtcacgttgactagtcagtgaagtccgaggcgagaggacgaggcagtactattatagacaagagtanacagtagacggttactgtagttgggtgttcgggcggaagggaccgaaggcgtacgcccgtccgtaggtccgacgcccgaaggcctcgccccgtcgg

SEQ ID NO: 201233 - DNA, 598 bp, Homo sapiens
  misc_feature: GYAE6OF01BP3D3.21.46.E02.1.454.CMB.1.raw
  modified_base (137)..(137): a, c, t, g, unknown or other
  misc_feature (137)..(137): n is a, c, g, or t
  modified_base (168)..(168): a, c, t, g, unknown or other
  misc_feature (168)..(168): n is a, c, g, or t
  modified_base (311)..(311): a, c, t, g, unknown or other
  misc_feature (311)..(311): n is a, c, g, or t
  modified_base (470)..(470): a, c, t, g, unknown or other
  misc_feature (470)..(470): n is a, c, g, or t
  modified_base (537)..(537): a, c, t, g, unknown or other
  misc_feature (537)..(537): n is a, c, g, or t
  modified_base (549)..(549): a, c, t, g, unknown or other
  misc_feature (549)..(549): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgccanaggctctggagcctcctatgagctagacacncgcccacccgtcggtgtcagtcgtccccaggacaggacggccaggtatcacctgctcgtgacagtactggactgacaaagtaatctgtcttatcgtaaccaagagaacgcacggccgacggtccctgtagtagtgaatataanaagactacgtagacgtcgacccagagaagtcgtcctagacgcgtatccgtcgtacggtcctaccgacgtcgacgacgggaactcgctggtaacctcggttacaattacgacgtaacgtagtaaccgaccgaaggtacgaaggacggacgttacggaccngttaacctattcgtacgaactaacgaagttacacgtagtaagtcgttactgtagttgggcgtacggnggtaacggacgngtaccggtcgtacgtcgtacgtacgacgaccgagcctccgtcccgtacg

SEQ ID NO: 201234 - DNA, 562 bp, Homo sapiens
  misc_feature: GYAE6OF01EKXXT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggccaggcccctgtgttagtgatatataaagacactgagacggccctcagagatcccgtgagcgtattctcgtgctccagctcgaggacagcagtctacgttgactatcgagtagaagtccgaggacaggtacggacgaggcgtagacttattacgtagtacaagagtaagacgtagtagtagtactacgtaggttagggtggttacgggcgggtaagggaccgtaacggtcgtaccggaccgtaccgttacggtaccgacggaccccgaaggtccgtcccggtcccccgtcgg

SEQ ID NO: 201235 - DNA, 547 bp, Homo sapiens
  misc_feature: GYAE6OF01CC2FH.21.46.E02.1.454.CMB.1.raw
  modified_base (178)..(178): a, c, t, g, unknown or other
  misc_feature (178)..(178): n is a, c, g, or t
  modified_base (217)..(217): a, c, t, g, unknown or other
  misc_feature (217)..(217): n is a, c, g, or t
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
  modified_base (337)..(337): a, c, t, g, unknown or other
  misc_feature (337)..(337): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcacctgctcngcagatggactgaccaaagaaatatgcttattggtaccaacagaagccaggccacggcccctgtgttagngatatataaagacactgagacggccctnagagactcccgtgagcgattcnctggctccagctcgagggacagcagtcacgttgactatcagtagaacgtcccgaggcgaggaggacgaggctagactattactagtacaagagtaagacaggtagagttactcgtagttgggtgttcgggacggtaacgggaccaaggtctacggtacccgtccgtaaggaccgacggacccgaaggtccctaccggtcccccgtaccgg

SEQ ID NO: 201236 - DNA, 585 bp, Homo sapiens
  misc_feature: GYAE6OF01A1MV5.21.46.E02.1.454.CMB.1.raw
  modified_base (295)..(295): a, c, t, g, unknown or other
  misc_feature (295)..(295): n is a, c, g, or t
  modified_base (323)..(323): a, c, t, g, unknown or other
  misc_feature (323)..(323): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggactcacctgctctgcagatggactgaccaaaagaaatagtgtactttattacggtaaccaaacagaagccaggccaggcccctgtgttagngatataataaagacactgagacgccctnagagactcccgtagacgcgtattctcgtgcctcagctacgaggtacagcagtacacgttgactatcgagtagaacgtcaggacaaggacggacgaggactagacttatacgtagtacaaacgagtaacgacgtaaggtagtaacgtacttagtacgttagggttggtaccgggtcgggaaacgggtaccgaaggtccgtacggtacccggttacctacgggtaccacggacccgaaggtccctccggtcccccgttaccggg

SEQ ID NO: 201237 - DNA, 548 bp, Homo sapiens
  misc_feature: GYAE6OF01AVO3J.21.46.E02.1.454.CMB.1.raw
  modified_base (313)..(313): a, c, t, g, unknown or other
  misc_feature (313)..(313): n is a, c, g, or t
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggcccctnagagatcccgtgagcgattctctggctcagctcagggacngcagtcacgttgactatcagtgacgtccaggcaggaggacgaggctggacttattactgtacaaangtaacgagaagtagaggtactacgagttgggttgttcgggacggagggaccgtaacggcgtaggtcccgtaccgttacggtaccgagggtaccccgaaagggtcccgttccgcccccccgtttaccggg

SEQ ID NO: 201238 - DNA, 768 bp, Homo sapiens
  misc_feature: GYAE6OF01AK6T2.21.46.E02.1.454.CMB.1.raw
tcagtcgtcgctcgcacgaccggtgctcgatttagactcatctacagggaaagggggtgggtccgaggaggcagaactctgggtgtctcaccatggcctggatcctctacttctcccctcctcactctctgcacaggctctgaggcctcctatgagctgacacagcccacccgtcggtgtcagtcgtccccgaggacacgaccggccaggactccgacctcgcttctcgcagacgtcggactcgaacctaaaagaaagttactggtctttagttacggtaaccaacgtaacgaacgccgaacggtcccgaaccggtacccccgttaggttacggttaacggtacggtaagttaagtaacgttaaaacgaacctaacgtacggaacgaccgggtaccccctagaaacggtacgtaaccttcccggtaagccggtacgtaacctttcgtaccgtcgtcccgtaccacggtcccgtaggacgggacacggctaacggtaccgtacggttagtactacgtacgtacggtacgtaacggttacgacggtcgaaacgggtacggacgggtaacggtacgtacgtaacggttactttacgtaacgtaaccgtaagaacgtaagaacggtaagtacggtagttacgtacgttaggtacgggttggaaccgggttacgggaagggtaccgtacgggtccggtaaccgggttacctaccgggtaacgtcccggtaaacggacccgtaaccgggtcccgtacccggtccccggtcccgg

SEQ ID NO: 201239 - DNA, 698 bp, Homo sapiens
  misc_feature: GYAE6OF01EN7MW.21.46.E02.1.454.CMB.1.raw
  modified_base (214)..(214): a, c, t, g, unknown or other
  misc_feature (214)..(214): n is a, c, g, or t
  modified_base (238)..(238): a, c, t, g, unknown or other
  misc_feature (238)..(238): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctgacacagccaccctggtgtcagtcgtccccaggacagacggccaggatccactgctntgcagatggactgaccaaagaatntgacttatggtaccaacagaacgcaggccaggccctgtgtagtgatataataagacactggagacggtccctagacgagtactcccgtaggacgtacgtaattccttacgtcgggacccttccgaagtcctaccggaaggggaacccgagtccgaacgttccgttaacggttcgtaacgttactaccgagggttacgaaacggttcccgaacgggacgaagggtaaccgggaaccggacgggtacgttaacgtaaagtttaccgtttaacgtacgtaaccaaaacgtaggaacgtaaccgtaggtaaacgtacggttaacttaacggtaggttacgggttggtaaccggggtaccgggaaagggtaacccgtaagggttacgtaccccgtaacggttacccgtaacgggttaccaccgtaaacccgggacgtcccggtccccgtcccccgttaacccggg

SEQ ID NO: 201240 - DNA, 862 bp, Homo sapiens
  misc_feature: GYAE6OF01D3B5E.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctctatgagctgacacacgcccacccgtcggtcgtcagtcgtccccaggacaggaccggccgaggactcacctgctcgtgcgagtagtcggactacgaaccaaaaagtaaattatacggtactttaacgttacggaacccaaagaacggaacgaccgaacggacctacgggtccccttaggttacggtttaaggttaggaaattaagtttaaagaaaaacggtacctaacgttaggaacggaaccggtaccccttagaacggtaacgtacccgttacccgtaaggacggtccgttacgttccttcggtcgcccgtactacggtccgtacggaacggggacaacggtccgtaaaggtaccgtaacggtttacgaacttaacgtaccgtaaggtaaccggtaacggttacccggaagggtaaccgaagggtacgggacgaagggtcgttaaacgtaactttaactacgtacgtaacgaaaacgtacggttaacgaaccggtaagggttaaacggtaaccggtttaacgttacgggtttaacgggtttcggggggtaacggtttaccggggaacccgggggtaaaccgggtaaaccgtaacgggttacccgttaacccgggtaaacccgggttaccggtttaacccgggaacccggttaacccgggaacccgttaacccgggggaccctttccccccggggacccccggtttacccgg

SEQ ID NO: 201241 - DNA, 722 bp, Homo sapiens
  misc_feature: GYAE6OF01BLYJO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtgtcagtcgtccccaggacagaccggccaggatcacctgctctgcagatggactgaccaaagaaatatgtactttattacggtaaccaacgagaacgaccgacggccacggtccccgtggttacggttagtacgtaataataaataaacgactacgtaggaacgaccggtaccctagaacgaagtaccttccccgtaggacgtacgtactttcgtacgtcggacctaccgacgtaccgtacggaacgggtacacggactacggtaccgtacggttacgaacgttatacgacggtaggaacgtaccgaacggtacgaacgggtagggaccggaggtctacggtaacttaacgttacgtacgtaaccaaagtacggtaaagaccgtaaggtaacggtaaggttacttaggttacggttggggttacggttacggggaccgggtaacgggaaccgtaaggtcccgtacgggtacccgttacccggtaaggtacccggtaaccggtacccggtaaccggtcccgttccccggtcccccggttaccgg

SEQ ID NO: 201242 - DNA, 666 bp, Homo sapiens
  misc_feature: GYAE6OF01E4VL6.21.46.E02.1.454.CMB.1.raw
  modified_base (290)..(290): a, c, t, g, unknown or other
  misc_feature (290)..(290): n is a, c, g, or t
  modified_base (385)..(385): a, c, t, g, unknown or other
  misc_feature (385)..(385): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaatatgtcttatggtaccaacgagaagccaggccacggccccctgtcgttagngatataataaagacactgagacggccctgagagactcccgtgacgcgattctctcggctccagctcgaggacagcgagtccgtaacgttgaactntacgagtacggaaacgttcccgaaggacctaagggaacggacgggtacggtaccttacggtaaacctttaacttaacgttacggtaactaaaaccgaggttaacggaacgtagggtaaacgttacgggttaaccttagtacggtttacggggttaggtttacccggggacggggtaaaccgggtacccaacgggttctaccgggtaacccccgttcggaacgggttccgaaccggtaccccccggtaaagggtcccctcccggtccccccggtttacccgg

SEQ ID NO: 201243 - DNA, 682 bp, Homo sapiens
  misc_feature: GYAE6OF01BPWIA.21.46.E02.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagntggactgaccaaagaaatatgtcttattcggtaaccaaacgagaacgccgaagggccacggtccccctggttacggttagtgtaatataagtaaacgactacgtagagacggtccctacagagactcccgtgacgcgattcctcgtggtccctccgacgtcctcggaagggacctagcgtaacgtcgtacgtacgtactactcgtagtagaacgtacccgaggacgaggacggtacgaggtcgtacgtacttaacgttacgtacgtaacgaaacgtagtaacggaagtaacggtaaggtaacggttaaccgtagttagggtttacgggttagggttccgggacggggtaaacggggtaccgtaacggtccggttaccgggtaccccggttcggttaacgggtaccgaaccggtacccggaaccgggtccccgtccccgggtaccccccgttcccggg

SEQ ID NO: 201244 - DNA, 637 bp, Homo sapiens
  misc_feature: GYAE6OF01BV94Y.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacaggaccggccaggatccacctgctctgcagatggactgaccaaaagaaatatgtactttattaggtaacccaaacagaacgcccgaacggaccgacggcccccttggttcggttagtggaattataagtaaaagaccaacgttaggacggacggccctacgaagacgtactcccgtaggacgcgtattctcgtggcctccgagctacggaggacagctacgtcgtacgttagacttactacgagttacgaacgtccgaaggcaagggacggacgaggcctagtaacttactttacgtgtaaccaacgtagtaacgaacgtaggtaaggtacggttacctagttaggtttggggttcggttacggggacggacgggaccgaacgtcggtacggtcccgtacgtacggaccgacgacccgaggccgtcccgccccggtaccg

SEQ ID NO: 201245 - DNA, 766 bp, Homo sapiens
  misc_feature: GYAE6OF01AGWOK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggatcacctgctctgcagatggactgaccaaagaatatcgtctttagttacggtaaccaacgacggaacgacccgacggcccgaaccgggtccccctggttacggttagtacgtaattaacgtaataaacgacctacgtaggaacggaccggccctacgaacgacgtacctcccgtaggacggtacgtacgtttccgtccgtcggcccttccgacggtccgtacggacgggaccacggacgtaacgtccgtacggttacgtaaccttagtacgtaaggtacggaaccggttaccggaacgggtacgaagggaacgggaccgggtacggtcgttaaccgtaacttaacgttaaccgttagtaaaccaaacggtaggtaacgaacgtaagggttacggtaacggttaccttaggtacgggtttcggggtaccgggttacgggaccggggtaaccgggtaaccgtaccgggtcgtaaccgggtaccccgtttaaccgggtaccggtaccgtaccccggtacccggtacggtcccccggttccccggtcccccggtttacccgg

SEQ ID NO: 201246 - DNA, 711 bp, Homo sapiens
  misc_feature: GYAE6OF01D3R2N.21.46.E02.1.454.CMB.1.raw
  modified_base (258)..(258): a, c, t, g, unknown or other
  misc_feature (258)..(258): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgcccacccgtcggtgtcacggttccgtcccccgaggaccgacgaccggccaaggactccacctgctctgcagatggactcgaacaaagaatntgtacttagtacgtaacctaacgagaacgccgacggaccgacggtccccgtgtcgttagtacgtattataagtaaagacacgtagacgacggcctagagacgtacgtaccgtagacgtccgtattccgtcgtcggcctaccgacgtccgtacgaacgggtacacggtacgtacgtaccgtacgtttacgacgttagtaccgtaagtacggaaccgtacgacgggtacgaacgggaacggacggaacggtacgtacgtaacgttaaccgttaacgtacgttaaacaaacgtacggtaacgaacgtaaggttaacggaacggttacgttaacggtgggtttacgggtacgggttcgggacgggtaacgggtaccgtaacggtccgtacggtacccggtaccgtacggtaccgaccgacccggtaccggtcccgtccccggtccccgttacccggg

SEQ ID NO: 201247 - DNA, 704 bp, Homo sapiens
  misc_feature: GYAE6OF01BQ5A5.21.46.E02.1.454.CMB.1.raw
tcagtcgtcgctcgcacgaccggtgctcgatttagactcatctacagggaaaggggtggtccaggaggcagaactctgggtgtctcaccatggcctggatccctctacttcctcccctcctcactctctgcacaggctctgacgtcctcctagtgagctgacacgacgcctacccgtggtgtcacgtcgtaccccaggacagaccggccgaggctccactgctcgtgacagtagtaggactcgaaccaaaagtaaactgtgacttattacggtaaccaacacgaagccgacggacctacggcccctagtcgttagtagtaattaagtaagtaaacactaacgtagaacggtacggtacccctagacgaacgtacctaccgtacggacgtacgttaacttccgtacgttcgtctaccggtaactcgtacgaaggtaccgagtaccgtacggtaccgtacgttacgtaactacgtacgaagtacgtaaccggtacgaggaccaagggacggaacggacggtacgtacggtaacgtaagtaacgttacgtaaacgtaacgtaacggaactacgtaacggttaaaggtaccgttaggtacgtagggttcgggtacggtacggtaggtaaccgggaccgtagtccgaacggttcccgtacggttaacgcccgttacggacccgttaggcccctccggcccctaaccggg

SEQ ID NO: 201248 - DNA, 710 bp, Homo sapiens
  misc_feature: GYAE6OF01CR028.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgccaccctcggtgtcagtcgtccccgaggaccaggacggccaggactccacctgctctcgacagagtggactcgaaccaaaagtaaatgttcgtactttagttacggtaaccaaacgaaggaacgaccgacggtaccgacggtcccctaggtttcgtaagttagaagttaactaaataacgaacgtaacgacggtaacgacggtaccctacgaacgtaacgtaacgtcccgtagacgtaacgtgttccgttcgtcgtcccgtactacgccgtacggaggtacacgtacgtacgtacgacggttactaacgttacgtacgtaaggtacggaacggttaaccggaacggacgtaacgggacggaaccggtgtacccgtagtactaagttaacgtataacgtaaacgaacgtagaacgtaaggttacgtagttaactaagtcggttaggtacggtacgggaccggtaacgacggtacgtaccgtacggttaaccgcgtaacgggcctaacgggacccgtaaggtccccgtccggtaccccgtaccgg

SEQ ID NO: 201249 - DNA, 508 bp, Homo sapiens
  misc_feature: GYAE6OF01EPYC2.21.46.E02.1.454.CMB.1.raw
  modified_base (312)..(312): a, c, t, g, unknown or other
  misc_feature (312)..(312): n is a, c, g, or t
  modified_base (422)..(422): a, c, t, g, unknown or other
  misc_feature (422)..(422): n is a, c, g, or t
  modified_base (454)..(454): a, c, t, g, unknown or other
  misc_feature (454)..(454): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctgagcgattctctggctcagctcgagggacagcagtctacgttgactatcaagtgaagtccaaggcagacggacgaggctagactattacgtgtacaaacngtagacagtagagtactgagttggtggtcggnggaggacgaagcgtacgaccgtccgtaggcacggccaaggcctcgccccgtcgg

SEQ ID NO: 201250 - DNA, 790 bp, Homo sapiens
  misc_feature: GYAE6OF01EI5FH.21.46.E02.1.454.CMB.1.raw
  modified_base (137)..(137): a, c, t, g, unknown or other
  misc_feature (137)..(137): n is a, c, g, or t
  modified_base (561)..(561): a, c, t, g, unknown or other
  misc_feature (561)..(561): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacgnggctcgtggacggcctcctatgacgctgacacacgcccaccgtggtgtcgagtcgtacccgaggacgacggaccggccgaggactccacgtgcctcgtcgacagtacggtcggaactacgaaccaaaagtaattactacggttactttaacgttacggtaaaccaaacggacggaaccgacccggaaccggaccggtaccggtcccgtttagggttaggttacggtataaacgttaaagtaaacgtaaaacggccgtacgtagggaaccggtccggtacccgtaagacgggtaacgtaccctccgtaggacgtacgttacgttctccgtacgtacctacgacgtccggaggacgtacgagtcgagtctaagtcgacttacgtacgtagacgtaccgtaggacggacgaacgggtacggacggtntacgtaccgttaattaacggttacgtaacggtaacctaaggtaacggaacgtaaaggtacggttaacggtaccgggtttacgtagggttaacgggtttccgggttacgggggttacccggaacggggtaacgaacccggtggttacccggacggtttaaccccgggaggtttacccggaacccgtaccggaacccggtccggtaccccgtccccggtacccgttcccgg

SEQ ID NO: 201251 - DNA, 796 bp, Homo sapiens
  misc_feature: GYAE6OF01AG3RM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgcccacccgtcggtgtcagtcgtccccgaggacacggaccggccaggatccacctgctctgcgagatggacctagacccaaaaggaaatagtacgtactttagttacggtaaccaaacgaacgaaacgcccgaacggcccgaccgggtcccccgttgttacggtttacgtagtaattaataacgtaaaacgacgacgtagaacggacgtccctacgagacgtactccgaggacgcgtattctcgtcgcctaccgacgtcctacggagggacacgacgtacgtcgtacgtagtactagtacgtaggtacgaccgtcggaacggacggaacgggaacgggtaccgggacgggttaccgtaacgtttaaccgttaacgtttaccgttaacgtaaaccgtaaacggttaacggtaaacggaacgttaagggttaaaccgggaaggtttaacccgttacggtttaacggggtttacggggtttacgggttacccgggggaaccgggtaaaccggggtaacccgaacgggttcccgggttaacccggtccccggtttaccggtaacccgggtaccggtaacccgggtaccccgtaaacgggttccccggttcccccggtacccccggtttacccggg

SEQ ID NO: 201252 - DNA, 275 bp, Homo sapiens
  misc_feature: GYAE6OF01CQC6R.21.46.E02.1.454.CMB.1.raw
  modified_base (142)..(142): a, c, t, g, unknown or other
  misc_feature (142)..(142): n is a, c, g, or t
  modified_base (156)..(156): a, c, t, g, unknown or other
  misc_feature (156)..(156): n is a, c, g, or t
  modified_base (250)..(275): a, c, t, g, unknown or other
  misc_feature (250)..(275): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcgtcttcccctggcnccctgctccaggancacctccgagagcacagccggccctgggctgccgtggtcaaggtacctaccttcccgagcgacgactggagcgggctggccaaggcgcagtagnnnnnnnnnnnnnnnnnnnnnnnnnn

SEQ ID NO: 201253 - DNA, 810 bp, Homo sapiens
  misc_feature: GYAE6OF01CBOS5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtccagtcgtccccaggacagacggccaggatcactgctctgcagatggactgaccaaaagtaaatagtgtactttaagttacggtaaccaaacgaaggaacgaccaacgggcccgtaacggcccccgttaggtggtttaaggtacgtaattaataagtaaaagactaacgtaggaacggaccggccctacgaaggagtacctccccgtaggacgaccggtaactttcgtcgtacgggtccttacccgagtaccgtacggaacggggtaaccacggaccgtaaggtacccttaaccggtttacgtaaccttaacgtccgttaagggtaacgggtaaaccttaccccgggaaagggaccgaaaggggaacggggaaccgggtaacgggtaccgttaacggtaaccgttttaaacggtttaaccgttaacggtaaacccgtaaaacggtaaggtaaaccggtaacgtaaacgggttaacgggtaacggtttaacgtaaccgttagggtttagggggttacggttaccgggacggggtaaccgggaacctaacgggtacccgtacgggtaccccgttccgggtaacgtaccgaaccggaccccggtaaggtccccgtcccgggtcccccgttaccggg

SEQ ID NO: 201254 - DNA, 771 bp, Homo sapiens
  misc_feature: GYAE6OF01BRV39.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctgcagatgactgaccaaaagtaaatatgactttagttacggtaaccaaacgagaacgccgacggccgacggccccgtgtgttagtgattaataagtaaagactacgtagaacgacggaccctacgagacgtactcccgtagacgcgtacttcgtccgtcggcctacgacgtcgtacggacgggacacggacgtacgtaccgtacgtttacggaacttaagtccgtaaggtacgtaacgttaccccggaaggacccgtaagggtaaccgggaacggtacggtaccgttacggtaaacccgttttaacttaccggtttaaggtaacccgtaaaacggtaacggtaaacggtaaaccgtaagggttaaacgggttaacgttaaccggttaggttacgggtttacgggggttacgggtttacccgggggaccggggtaaacgggtaacccggtacggttaccggtacccgggttacccgggttaccgttaaccgggtaccaacccgggtacccccggtaaagggttcccccgtacccggtcccccccggtttaccggg

SEQ ID NO: 201255 - DNA, 584 bp, Homo sapiens
  misc_feature: GYAE6OF01ESBI9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagacggccctcagagactccctgacgcgtattctcgtggcctccgagctacgagggacagcagtccgtacgttgacttactcagtagaacgtccgaggacaggaggacgaggctagaactacttacgtagtaccaaagtagtaagaacgtaggtaagacggttactacgtaggttcgggttggttacgggacgggaacgggtaccgaaggtcgtaccggtacccgttcggtaacggtcgtaaccggaccccgaacgggtccgtcccgtcccccgttaccgg

SEQ ID NO: 201256 - DNA, 721 bp, Homo sapiens
  misc_feature: GYAE6OF01DRHZ7.21.46.E02.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctctatgagctgacacacgcccacccgtggtgtcagttccgtaccccgaagggacacggaccggcctaagggactccaccgtgccttcgngcagagtcggactagaaaccaaaaagtaaatgtacgtactttagttacggaaccaaagagaacgccgacgccgacggtcctgttagttagtagtaattaataagtaaacgacctagtaggacgacgccctagagtacgtacctccgtagacggacgttacttcgtacgtcgccctacgacgtcgtacggacggacacgacgtacgtaccgtacggttactaacttacgtagaacggtaggaacgtacccggaaggacgtaaagggacgggacgacggtactaacgtactttaacttacggtactaaaccgaagtacggtaaacacggtaggtaacgtaacggttacttacgttaggggttacgggtcggtaccggggtacgggaaccggtaacgtaacggtccggttaaccggtacccggttacgtaaccggaccgtaacccgacccggtaagggtcccccgttcccggtccccggttacgg

SEQ ID NO: 201257 - DNA, 614 bp, Homo sapiens
  misc_feature: GYAE6OF01C7SXW.21.46.E02.1.454.CMB.1.raw
  modified_base (344)..(344): a, c, t, g, unknown or other
  misc_feature (344)..(344): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggccctcctatgagctgacacagcccacccgttcggtgtcagtcgtaccccaggacagacggccaggactccacctgctctgcagatggactgaaccaaaagaatgtgtactttagtacggtaaccaacgagaacgccgacggaccgacggcccctggtcgttagtagatataagtaaacgacagtgacgacgccctanagacgactccgtagacgcgtattctcgtcgcctcgagtcctacggaacggacgagactacgtacgtacgttcgacttagtcgtagtacgaacgtcgagacgaaggacggacgaggctagtacgttacttacgtagtaacaagtagtaacagtagtagtacgtacgtacgtaggttacgggtacggttacgggacgggtacgggaccgtacggtacgttacggtaccgtacggtagtaccgacgacccgaggtccgtcccgtcccgtaccg

SEQ ID NO: 201258 - DNA, 686 bp, Homo sapiens
  misc_feature: GYAE6OF01BE914.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgctctgcagatggactcgaccaaaagaaatagtgtcttattacggtaaccaaacaaggaacgaccgacggccacgggccccctggttactcggtacacttccagtcggacggacacggtccgaacgacgaccgtaccggggacttaccccgtgaacggtagactttccgtacgtcgcccctccgagtcctacggaacgggaccaggtacacggttacctaacgttcgtaacttataccgtaagttacgaacggttacccgaggacctaggaacggggacgacgggctaaggtactaactttacgacgttaacaacgtaaggtaagtaacgtaaggtaacggagttaacgtacgttaggttacgggtggttacgggaccgggacgggtaaaccggaacggtccgtacgggtacccggttaccggacggtacgaccggacccgtaacggcccgtccgtccccggttcggttacccg

SEQ ID NO: 201259 - DNA, 640 bp, Homo sapiens
  misc_feature: GYAE6OF01CIDAU.21.46.E02.1.454.CMB.1.raw
  modified_base (131)..(131): a, c, t, g, unknown or other
  misc_feature (131)..(131): n is a, c, g, or t
  modified_base (262)..(262): a, c, t, g, unknown or other
  misc_feature (262)..(262): n is a, c, g, or t
  modified_base (355)..(355): a, c, t, g, unknown or other
  misc_feature (355)..(355): n is a, c, g, or t
tcagtcgtcgctcgcacgaccggtgctcgatttagactcatctacagggaaggggtgggtccaggaggcagaactctgggtgtctcaccgatggcctggatccctctacttctccctctcactctctgcanaggctctgacggcctctatgagctgacacagccaccgtggtcgtcagtcgtcccaggacagaccgcaggatcacctgacctcgtgcagactggactgacaaaagaatatcgactttagtacggtaaccaanagaacgcgaggccacggcccttaggtgttagtgaatactaactaagacacgtagacggacgcctacaggtacgactccgagagcgtatctcgnggtctcagcctagacggactagctagtacgacgtttagactatgtaacgtacgaacgtacgacgacgaaacggtaggacggtacggtacttacggaaacttacggttttacgagttaaaccgaaacgttaagaacggtaccgtaaagggttacgtaacggttaacttaccggttaaggtttcggggtacgggtttaacgggacggggaacggtaccgtaaacggtcgttacggtaccgttccgtacggtacgtccgaaccccgagccgtccggtccccttaccgg

SEQ ID NO: 201260 - DNA, 849 bp, Homo sapiens
  misc_feature: GYAE6OF01CPV78.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccacccgtggtgtcaggtcgtccccaggacaggaccggccaggactcacgctcgctcgtcgacgagacgtcggtactacgaaaccgaaaaagtaattacgtgttacgtttacggttaaccggtaaaccaacgtaacggaaccgaccggaacggacccgtaccgggtaccccgttagggttacggtttaggtaacggttaactaaacgttaaagtaaaacgtaccgtaacggtaaggtaacgggacccgttaccccgtacggaacgggtaacgtacccgttacccggtaaggtaccggtacgtttaaccgtttccgttccgggtccgttacccgtaccgtaccgggtaccgtaaccggggacggtaacgacggtaccgttaacgggttaccggttaccgttaccgtaacttaaccggttacgtaaacggggtaccggtaacccgtaaccgggacggtaacgggaacgggacgggaacggtcggtaacgtacggttaactttaacgttacgtaaccgaaacgtaaacggtaacggtaacgaacggttaggtacggtaacgttcgtacgttaggggttgggtaccgggttacgggcgggtaaaccggtacgacggttacggcccggttaccgacggtttacggaccgtacccgaccggttacccgtccggtcccccggttaccccgg

SEQ ID NO: 201261 - DNA, 773 bp, Homo sapiens
  misc_feature: GYAE6OF01CGITD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccacccgtcggtgtcagtcgtccccaggacacggacggccaggactcacctgctctgcagatggactgaccaaaagaatagtgtacttagttcggaaccaacaggaacgccgaacgggcccgaacggccccgttaggttagttacgtggaattaagtaataaacgacactaggacgtaccggtccctacgaagtaagtaccttaccccgtaggagtaccgtactttccgtcgtacgggcccttaccgacggtcctaacggaacggggtaccaaggtccgtagtaccgtacggttagaacgttactacgtaaggttacggtaacgtaccggacggacgtaagggcggaacggacggtctaacgtaacgtttaacgtaacgtagttaaaccgaaacgtaacggtaacgaacgttaaacgggaacgttaacgggttacccttaaggtacgggttacgggggttacggttaccggggaccggggttaaacgggaccggtaaaccggggttcccgaacgggttaacccgggtacccggtttaaacggggcccgaacccgggttaacccggaaccgggtttaccccgtccccggggtccccccgtttaaccggg

SEQ ID NO: 201262 - DNA, 718 bp, Homo sapiens
  misc_feature: GYAE6OF01DLALV.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactagaccaaaagaaatntgtcttattaggtaaccaacgagaagccgaggccaggcccctgtgttagtgatataataaagacactagagacggccctacgagagactcccgtagagtcgtactttctcgttggccttccgagtcctaccggaaggggacctagaccgtaggtacgtaacggtttacgaacgttacgtacgtaaggtacggaaacggtcccggaagggaccgaaagggtaacgggaaccgggtaaggtccgttaaggtaacctttaacgtttaaccgttagtaaacccgtaaacgtaacggtaacggtaaaccgtaagggtaacggtaaacgggttaacttacggttaggtttagggggttacgggttaccggggacggggttaacgggaacccgtaaggacccggttacggtaccccggttaccgtacgggtaccgtaccgggacccgaacgggtaccctccccgggtcccccgtacccggg

SEQ ID NO: 201263 - DNA, 654 bp, Homo sapiens
  misc_feature: GYAE6OF01A3EDF.21.46.E02.1.454.CMB.1.raw
  modified_base (107)..(107): a, c, t, g, unknown or other
  misc_feature (107)..(107): n is a, c, g, or t
tcagtcgtcgctcgcacgaccggtgctcgatttagactcatctacagggaaagggggtgggctcaggaggcagagctctgggaatctcaccatggcctggacccctntcctgctccccctcctcactttctgcacagtctctggaggcctcctatgagctgacacagcccaccctggtgcagtcgtcccaggacaaacggcaggatcacctgctcgtggagattcgattgaaccaaaagattatacttgttcggtccagcaggagtcgaggccacggccctagtacgtggtacatccgagtggacggaccaggtaccggaccgaactaccgttccgggactcccctggaacgtagacttcgtctcggacctccgacgctacggacggacaggttcgacctacgttagactagtcggacggtcgggaccaggggtcggtaacgagtacggaacgtcgtacggtaacttacgttacgtttacgtacgacctaaccggagtaccgtaggttcggtacgtacgtagtacggggtaggggttacgttacccgggagggtaaccggacggttaaggtccggtaccgttacggttcggacgaccggtcccggagtcccgtcccgtccccggtacgtcctacccgttcgttcccgtcccccg

SEQ ID NO: 201264 - DNA, 564 bp, Homo sapiens
  misc_feature: GYAE6OF01A9F3V.21.46.E02.1.454.CMB.1.raw
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
  modified_base (371)..(371): a, c, t, g, unknown or other
  misc_feature (371)..(371): n is a, c, g, or t
  modified_base (427)..(427): a, c, t, g, unknown or other
  misc_feature (427)..(427): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaanagaagccaggccaggccctgtgttagtgatataataaagacactgagacgccctnagagactccctgacgcgtattctacgtggcctcagctacgaggacagcagtctacgttnaacttatcgagtgaacgtccgaggcgaggaggacgagctagacttattctacgaanaacgagtagaactaggtaagagttactatagttcgggtacgttcgggacggtaacgggaccgtaaggtccgtacggtacccggttcgtacggaccgtaacggaccccgtaagggtccctccgggcccccgttaccgg

SEQ ID NO: 201265 - DNA, 950 bp, Homo sapiens
  misc_feature: GYAE6OF01C8PC6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagccaccctcggtgtcagtgtccccaggacagacgccaggatcacctgctctgcagatggactgaccaaaagaatatagtctttaagttggtaaccaaacgaagaaacggccgaacgggacccgaacggcccccgttggttaggttaggttagtaatataaagttaaaacgacaccgttagaacggacggacccctagaagaagtactacctggaacgtcggtaactttccgtcgtcgggtcctaccgaagtccgttacggaacggggtaaccacggacgtaacggtaccgttaaccggttttacgaaccgttaacttaccgtaaagggttaaccggtaaaacggttaccccggtaaacggggtaaccggtaaaacggggaacggggttaaccggggaaacggggtcccgtttaaacggggtaaacctttaaaccgtttttaaaccggtttaccggttaaaaccggtaaaaacccgttaaaggggttaaacggtaaacccgtttaaaagggggttaaacgggttaaaacccggggtttaacctttaacccgggttaaagggggtttttcgggggtttaaaccggggttttcccggggggaaccggggggtaaaaccggggtaaaaccccccgggttaaaagggtaccccgggtttaaacccgggttaaacccccggggtttaaccccgggttaacgggtttaacccggaacccggggtaaaccccccgggtaaggggttaacccccggtttaccccccgggaccccccggttttaacccccggggg

SEQ ID NO: 201266 - DNA, 790 bp, Homo sapiens
  misc_feature: GYAE6OF01C6Q6L.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggactccacctgcctctgcagtagtggactcgaccaaaagtaaattatgactttaagttacggtaaacccaacgtaacgaacgcccgaacgggacccaaccggtcccccgttggttacggtttaacggttaggtaattaaacgttaaagtaaaaacggtaacctacgttacggaaaccggtacccggtaccccttaacgaacggtaaaccgtaccgttccccgttacgggaacggtaccggttaacttttcccgtccgttaccgggtcccttaccccgtaggtacccgttaccggaaacggggtacacggtaccgtaacgttaccgttacgtttacggtactaacgttcgtaaggtacggtaaacgtcccggaacggacgaacggacgggaacggtacggtacgttacgtaacttaacgttactaacgtaacgaaacgaaggtacaaacggagttacggtagttaccgttaggtaggttagggtcggttacgggaccgggtaacggtaccgtaacggtcgtaccggtacccggtacggttcggaccgtacggtacccgaaccggtccgttcccgtcccccgtacgg

SEQ ID NO: 201267 - DNA, 577 bp, Homo sapiens
  misc_feature: GYAE6OF01BCTL8.21.46.E02.1.454.CMB.1.raw
  modified_base (177)..(177): a, c, t, g, unknown or other
  misc_feature (177)..(177): n is a, c, g, or t
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (384)..(384): a, c, t, g, unknown or other
  misc_feature (384)..(384): n is a, c, g, or t
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtntcagtgtccccaggacagacggccaggatcacctgctctgcagatggactgaccaaagaatatgcttattggtaccaanagaagccaggccacgcccctgtgttagngatataataagacacgtgagacggccctanagagactcccgtgacgcgtattcctcgtcggcctccgagtcctacgacgggacagcgtagtcgtacgttnactatacgagtagacgtccgaggacaggacggacgaggtctagactatacgatacaacagtacganagtagtacgtactagtaggttgggtcgttcgggacggtagggaccctaaggtccgtaccggcccggttacgtacgggtaccgaccggtacccgtaaacgggccttccccggtccccccgttaccggg

SEQ ID NO: 201268 - DNA, 822 bp, Homo sapiens
  misc_feature: GYAE6OF01D176V.21.46.E02.1.454.CMB.1.raw
tcagtcgtcgctcgcacgaccggtgctcgatttagactcatctacaggggaagggggtgggtccaggaggcaggaactctgggtgtctcgaccatggcctggatccctctaccttctccccctcctccacctctctgtcacaggctcgttgacggccctccgtatcggagctgacacacgccacccgtcggtcgtcgagtcgtccccgaggaccaggaccggaccgaggactcacctgctcgtgacagattcggactcgaaccaaaagtaattagtagtacgtttagttacggtaaccaacgaagaacggtccgaacgggcccaacgggccccctaggttcgttacggtgaattacgtaagtaaacgacgacgtaggacgacgggacccctagtacgacgtacgtcccgaggacgtcgtacttcctacgtccgcctccgaagtccgtacggaacgggtaccagtaccgaacgttactaacgggtttacgaccgttaggtccggaacggttacgggtaaacgttcccggaaggtacggaacgggaacggtacggtaaacgggtctaacggttaaccttaacgtttaacgaaccgggttaactaaacggtacgggtttaaacgacccgggttaaggttaacgggtaacgggtttaacggtaccgggttaacgggtttagggggttaccgggttacggggtaaccgggggtaccggttaaaccccgggaggttacgttacccgggaaccccgtttccgggtaaaccgggacgtcccccgggtaaccgtacgggttcccctacccggttccccccggtaacccggg

SEQ ID NO: 201269 - DNA, 673 bp, Homo sapiens
  misc_feature: GYAE6OF01DVHU7.21.46.E02.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctctatgagctgacacagcccaccctcggtgtcagtcgtccccaggaccagacggccaggactccacctgctcngcagatggactgaccaaaagaatatgacttatcgtaacaacagaacgccgaggccacggtcccctgtacgttagtgaataataataaagacacgtagacggacggccctagaagacgtacctaccgtagacgacgtactttccgtcgtggccctaccgtacgtccgtacggaacgggacacgacgtaacgtctaacggttacgaacgttactcgtaagtacgaacgtacccgaaggaccgaaggtacggagtacggtctacgtacttaacgtttacgtacgtaaacctaaggtaacgtaacgaacgtaaggttaacggaagttacgtcgttaggtttcggggttacgttaccgggacgggtaacggaaccggtaacggtacggttccggtaaccgtacggttacgaccgtaccggtaacccgaggtaccccgtcccggtccccgttaccgg

SEQ ID NO: 201270 - DNA, 582 bp, Homo sapiens
  misc_feature: GYAE6OF01B62CJ.21.46.E02.1.454.CMB.1.raw
  modified_base (241)..(241): a, c, t, g, unknown or other
  misc_feature (241)..(241): n is a, c, g, or t
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagtcaccctggtgtcagtgtccccaggacagacggccaggatccacctgctctgcagatggactgaccaaagaaatntgtcttattaggtaaccaacagaagccacggccacggtccccctgtgttacgtgtatataataaagactactaggagacgccctanagagactccagagcgtattcnctcggcnccacgctacgaggacagcagtccacgttgactatacgagtacgacgtacgaggcgaaggtacggacgagtctagtacttacttacgtagtaaccgaagtaagtacgaacgaggtaaggtagttacgtagtaggttgggttacggtacgggacgggacggaaccgtaggtccgtacggttaccgcgtacggtccacggacccgaggtccgtcccggccccgtaccggg

SEQ ID NO: 201271 - DNA, 642 bp, Homo sapiens
  misc_feature: GYAE6OF01BA31C.21.46.E02.1.454.CMB.1.raw
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (397)..(397): a, c, t, g, unknown or other
  misc_feature (397)..(397): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcaggtcgtcccccaggacaggacggccaggatccacctgctctgcagatggactgaccaaagtaaatatgtcttattcggtaaccaacaagaacgccaggccacggcccctgtgtagngatataataagacacgtgagacggcctnaagacacttccctagacgcgtattccgtcgtggcctcagtcctcgaacgggacagctagtactacggttnaacttatcgagtagaacgtcccgaggtacaggaacgggacgacggacttacgtaacttacgttaacgtcgtaaacaaacgtaggtaacgtaacgaacggttaagtaacggtttactacgttaggtttagggggtcggttacggggaccggtaagggaaccgtaacggccgtaccgggtaacccgttaccggacggtacccgtaccgggacccgaacgggtcccttacccggtcccccgtaaccgg

SEQ ID NO: 201272 - DNA, 563 bp, Homo sapiens
  misc_feature: GYAE6OF01CX8B7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgctttagttggtaaccaacagaacgccaggccacggccctgtgtagtgatataataaagacactgagacggcctagagagactcccgtagacgcgtacttccgtcgtggcctccgagctcggaggacagcagtcgtacgttagacttatcagtacgaacgtccgaggacgaaggacggacgaggcgtagacttattacgtgtaacaaacgagtaagaacgaggtagtacggtaactcgtagttggggtcgttcgggacgggaggaccgagtcgtacggtccgtcgtagacgacgacccgaggccgtcccgccccgtacgg

SEQ ID NO: 201273 - DNA, 710 bp, Homo sapiens
  misc_feature: GYAE6OF01AM4IL.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctcctgctccccctctcactttctgcacagtctctgaggcctcctatgagctgacacagcccacccgtcggtgtcagtcgtcccgaaggacaaacggccaggatccacctgctcgtggagtacttcattcgaaccaaaaagtattagttactttggttcgtaccagcaagaacgtcacggccgacggtccctagtactcggtacactcccagtcggacgaccgtacggtccgaccgactaccggtccgggtactcccgtaggacgtagttacttcgtccgtaccgtccccgtacgacggtaccgtacggaccgggtacgtacggtccggacccttacgttcgaaccttaggtaccggacggggtccgggacccgtaggggtacgaacgtaggttacggaaacgtcggttacgtaaccttaacggtttacttacgggtacccaccgtaaccgtagtacgtagggttacgtcgacggtacgtacggggtaacgggttcgtacggggaacggtaggtaccgtaggttcccgtacggttcgtacggacgaccggacgtcggtccgtccccgcccgttggaccttactcccggttccctccccggtccc

SEQ ID NO: 201274 - DNA, 543 bp, Homo sapiens
  misc_feature: GYAE6OF01CRDV9.21.46.E02.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctggtgtcagtgtccccaggacagacggccaggntcacctgctctgcagatggactgaccaaagaaatntgcttattggtacaacagaagccaggccaggccccctgtgttagtgatatataaagacactgagaggccctcagagatccctgagcgattctcgtggcctcagctcgagggacagcagtcacgttgactatcagtagaagtcccgaggcaggaggacgaggctagacttattacgtgtaccaaacgtagtaagacaagtagaagttctacgtagttgggtgttcggacgggacgggtacgagcgtacggacccggttacgtaggtacacgaccccgaaggcctccggtcccccgttaccggg

SEQ ID NO: 201275 - DNA, 660 bp, Homo sapiens
  misc_feature: GYAE6OF01BCXI5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctaacttcctccccctcctcactctctgcacaggctctgaggcctcctatgagctgacacacgcccaccctcggtgtcagtcgtccccaggacagacggccaggatcacctgctctgcagatggactgaccaaaagaatatgtactttagtacggtaaccaagagaacgccgacggaccgacggtccccttggttacgttaggtagaagttaattaaacgtaaaagactacgtaggaacggacggtacccctagaaggaacgtacctaccgtagacgtcgtattcctcgttcggcctaccgagtcctacggacggggaccagaccgtagtccgtaacggtttgaaccttagtcgtaaggttacgaacgtccggaaggacgaaggaacggacgagtactagtacttacttacgtacgtaacaacgtagtacgaagtacgtaggttacgtaacgttggttagttggggttacgcgggacgggaaacgtacgacgtacgtacggaccgttaccggtaggacaccggacccgtaggcccgtcccgtccccggttaccg

SEQ ID NO: 201276 - DNA, 638 bp, Homo sapiens
  misc_feature: GYAE6OF01DJVU0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctgcagatggactgaccaaaagaatatgtactttagttacggtaaccaacgagaacgccgacggccacggccccttagtagttagtgtaataataagtaaacgactacgtagaggacggccctagagagtactacccgtagacgcgtactttccgtcgtacggtcctaccgacgtccgacggacgggtacacgtcgtacgtaccgtacgttcgaacttactacgtaaggtagaacgtcgaggacgaaggacggacgaggtctagtacttagttacgagtaacgaagtacgtagaacgtaggtagtacggtactacggtaggttcgggtacggtcgggacggaggaaccgtaaggcgtacggtccggttaccgtacggtaccgaaccggtacccgacggcccgtcccggtccccgtaccgg

SEQ ID NO: 201277 - DNA, 754 bp, Homo sapiens
  misc_feature: GYAE6OF01B344T.21.46.E02.1.454.CMB.1.raw
  modified_base (228)..(228): a, c, t, g, unknown or other
  misc_feature (228)..(228): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacagcccaccctggtgtcagtcgtacccaggacacggaccggcaggactcacctgctctgacagntaggactgaccaaaagtaatgtagtactttaagtcggaaaccctaagaagaacgaccgtacgggacccacggtccccttaggttacgtaaggtagtagttaataaacgtaagtaaacgacgtaggagacgcccgtacaggaacgtcgtacctacggnaccggtnttacgttcgtcggcccttcaaccggtctaccggacgggtaacgcgtacgtacgtacgtaccgtacgtacgtagttacgaggtaacgacggttaccgagggtaacaagggacgtacgggaacggtacgtacgtaactttactaacggttcaaaccgttaaacggaagttaacggaaccgtaaaggtcgggtaaaccggtttacgacggtttaggtacggggttaaccgggtttccggggaaccgggaaggggttaaaccggaacgttacggtttacccggaacgggtttaccccggtaacgggtaccgtacccgggtaacccgaacgggtttcccccgccgggtttaccccccggttaaccgg

SEQ ID NO: 201278 - DNA, 709 bp, Homo sapiens
  misc_feature: GYAE6OF01CCZ60.21.46.E02.1.454.CMB.1.raw
  modified_base (418)..(418): a, c, t, g, unknown or other
  misc_feature (418)..(418): n is a, c, g, or t
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgaggcctctatgagctgacacagcccacccgtggtgtacagtcgtccccaggacacggaccggccaggactccacctgctctgacagagtacggactacggaaccaaaaggaaatagtgtactttaagttacggtaaccaagagaacgaccgacggaccgacggtccctggttagttaagacgtaatataaagtaacgactagaggacggacggccctagaagacgtacttaccgagacgtactcgttctcgtcgcctacgagtcgacgagggaacncggtactacgtacgacggtttacaccgttagtacgaagtacgaacgtaccgagggaccgaagggtacggacgtaggtcgtaacgtaacgttattacgtagtaaacgaaacgtggttaaagccggtaaagttacgggtaacgttacttacggttagggttacggggttcggttaaccggggacgggtaaggtaaccccgtaggtacccgttaaccgggacccggttaccggtacggttacccggaaaccggttaccccgaaggtccccgttaccccggcccccgtttaccgg

SEQ ID NO: 201279 - DNA, 678 bp, Homo sapiens
  misc_feature: GYAE6OF01A46FY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgacttatcggtaaccaacagaagccaggccacggcccctgtgttagtgatatagtaaagacacgtgagacggccctagaagacgactcccgtaggagccgtattctcgtcggacctcgagtctcgagggacagacgtacgtactacggttagaacttatcgtagtagaacgtccgaaggacgaggacggacggaggtctaggtacttagtaactacgtaaccaaacgtaggtaacgacgtaaggttaggtaacggttacttacgtaagggttttcggggttacgggttaccgggggtaacggggtaaccggggtaaacccggtaaacgggtacccgttacccggggtaaccccggttacccggttacgggttaccgtaacccgggtacccggtaaacccgggtcccgttaccccggtcccccccggttacccggg

SEQ ID NO: 201280 - DNA, 694 bp, Homo sapiens
  misc_feature: GYAE6OF01C0MVN.21.46.E02.1.454.CMB.1.raw
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (371)..(371): a, c, t, g, unknown or other
  misc_feature (371)..(371): n is a, c, g, or t
tcagtcgtcgctcgcacgaccggtgctcgatttagactcatctacaggggaaagggggtgggtccaggaggcagaactctgggtgtctcaccagtggcctggactccctctacttcctccccctcctcactctctgcacaggctctgagcctcctatgagctgacacacgcccacccgtcggtgtcagtcgtccccaggacaggaccggccaggatcacctgctctgcagatcggctcgacaaaagtaatgtagctttagtacggaaccaagaagaacgccgaaggcctacgggtcccttggtagtttaagngtaaataactaagtaaacgctacgtagacgccggaccctagacgngtacctaccgaggngaccgttattcgtccgttggaccttcgacgtcgtacggaagggtacagcgttacgtctaccgtagactaatcgtagtacgtacgtacgacggacgtaaggacggaacgggtaggtacgtaaccggttactttaacgtttaacgtaacgtacggtaaaacgtacggtaacgtaaccggagttaaacgggtacggttaacgtacgttagggggtttccgtaggggttacccgggagggttaccgggaaccgtaacggtcgtaacggtcccgttacgtacggtacgacccggtaaccgtcggaccccgttccggtacccccgttcg

SEQ ID NO: 201281 - DNA, 579 bp, Homo sapiens
  misc_feature: GYAE6OF01DHI3I.21.46.E02.1.454.CMB.1.raw
  modified_base (335)..(335): a, c, t, g, unknown or other
  misc_feature (335)..(335): n is a, c, g, or t
  modified_base (474)..(474): a, c, t, g, unknown or other
  misc_feature (474)..(474): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggccctcctatgagctgacacagcccaccctcggtgtcagtcgtccccaggacagacggccaggatcactgctctgcagatggactgaccaaaagaaatatgacttattcggtaaccaacagaacgccaggccaggcccctgtgtagtgatataataagacatgagacggcctacagagactcccctgancgtattctcgtggcctcacgctcgacgggacagactagtcgtacgttagacttaacgtcctaggttacgaaacgttccgaaggaccgaaggacgggacgaaggcctaggaactttagttacttacgtacaaacgtaganaaccgagtaggagtctagtaggttggtacggttcggacgggtaggaaccgaagtcgtacggccctacggtacgcgtacgacccgagtccgccgtccccgtaccgg

SEQ ID NO: 201282 - DNA, 711 bp, Homo sapiens
  misc_feature: GYAE6OF01DIF7W.21.46.E02.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccaccgtcggtgtcagtcgtcccgaggacagacggcaggatcactgctctgcagntacggactacgacaaaagaaattgtcgtacttagtacggtaaccaacgagaacgccgacggccacggtcctggtacgttagagtaattataaagtaacgacagtaggaggaaccgtccctagagtacgaccgtccgtaggacgaccgttacttccgtacgtcgacctcgacgtcgtacggaagggacacggacgtacgtacgtaaccggttataaccgttacgtacggtaacgtacggtaacgtacccggaaggtaacggaacggaacgggaacgtacgggtacctaacgttacttaacgttacgagtaaaccaaacggtaggtaacgtacgaaagggttacggtaacggttacttaccgggttagggttaggggttacggttacggggaccggtaaacgggtaccgtaacggtccggtaacggttacccgttaccgtaggtaccgaacccgggtaccgtaccgggtccctccccgggttcccgtaccg

SEQ ID NO: 201283 - DNA, 692 bp, Homo sapiens
  misc_feature: GYAE6OF01DWLI0.21.46.E02.1.454.CMB.1.raw
  modified_base (217)..(217): a, c, t, g, unknown or other
  misc_feature (217)..(217): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagccacctggtgtcagtcgtcccaggacaaacggccaggatcacctgctctgganattcattcgaccaaaaaagtattattacttggttcggttccagcagaagtcaggccacggtccctgtactggtcatccatgacggccagtcgaacgtacaccgtccgggactcccgtgaacgagtacttcgtacctcgtccctaccagccgttacggaacgggtactacggtcggacccctacgtttggaaccttatcggacgggtcggggtacccgtaacgggtacgggacgtaggtagtaacgtcgttacgtaaccttaacgttacgtttacggtaaccgtaccaaccgtaagtacgtaacggttacggtacggttacgacgtcgggttaaggggtacgttcggggaacgggtacggtaaccgtacggttacgacccggttcgttacgggtaccgtacggacccggtacggccgttcccggtacccccgttcgggttaccctaaccgtttcccggttccgttccccgtccccg

SEQ ID NO: 201284 - DNA, 633 bp, Homo sapiens
  misc_feature: GYAE6OF01BWZDM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctgcagatggactgaccaaaagaatatgcttattaggtaccaacagaagccaggccacggcccctgtgtagtgatataataaagacactgagacggccctacagagatcccctgagcgattctctggctccagctcgagggacagcagtcacgttgactactcagtagaacgtccgaaggacgaggagggacgaggtactcgtaacttacgttaacgtagttaaccgaaacgtaggtaacgaacgtaggtaaggtaagggttacctagtacggtttaggggttacggtttaccggggaccggggtaacggggaacccgtaacggtaccgttaccgggtacccgttacccggttaagggtaccctaacccgggacccccgtaaagggtccccttcccggtccccccccgttacccgggg

SEQ ID NO: 201285 - DNA, 775 bp, Homo sapiens
  misc_feature: GYAE6OF01ECEBQ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccacccgtcggtgtcagtccgtccccgaggacacggaccggccaggactccacctgctctgcagtatggactgaaccaaaagtaatagtgtactttagttacggaaccaacgagaacgccgacggccaccggtccccttggttagttacgtagaattaagttaagtaaacgactacggttacggaacggtaccggtaccctagagaacgtacctacccgtaggacgtacgttacttccgtacgtcggtaccctaccgacggtacgtacggaacgggtaccgacggtacgtacggttaccgtacggtttacgtaacgttacgtacggtaaggttaacggaaccgggttaccgtaaacgggcggaaagggtaaccgggtacgggtaacggtccgttaacgttaaccgtttaacgtttaacgtaaccggtaaacgtaaacggtaagtaaacggtaacgtaaggggttaagttaaccggttagttaccgttaggggtttcggggtacggttaccgggtaagggaccggtaaccgtacggtaccggtaccggtcccgtacgggtagacccgtaaccggtaccggaccggtcccgtcccggtcccccgttcgg

SEQ ID NO: 201286 - DNA, 735 bp, Homo sapiens
  misc_feature: GYAE6OF01DXD9I.21.46.E02.1.454.CMB.1.raw
tcagtcgtcgctcgcacgaccggtgctcgatttagactcatctacagggaaagggggtggtccaggaggcagaactctgggtgtctcaccatggcctggatccctctacttctcccctctcactctctgcacaggctctgagcctctatgagctgacacacgccacccgtggtcgtcagtcgtacccaggcagacggccaggactccacctgcctcgtgcagtactacggaccttgaccaaaaaggtaaattctacggtactttacgttacggtaacccaaaccgagaacgaccgacggaccacgggtaccccctggttacggttagtacgtattaactaacgttaaacgacgtacgttcggaacggtacggacccgttacaacggaacgtacgtaccccgtaggtacgtccggttaactttcctccggttcgggtacctaccgacggtccgtaccggaggggacacgacggtacgttccgaacggtttcgacgttataccgtagtacggtaaacgccgaggacagggaacggtacgagtcgtagactttagttactaggtaacctaaagtacgaaggactaagggtaaggtacggtactaacgttagggttcgggttacggttccggggaacggtacggggaactaacggtacgttacccgggaacgtttacccgggtacggtaccaaacgggtaccccgggtaaagcccgtttccccgggcccccgtttacgg

SEQ ID NO: 201287 - DNA, 558 bp, Homo sapiens
  misc_feature: GYAE6OF01CXYXT.21.46.E02.1.454.CMB.1.raw
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
  modified_base (387)..(387): a, c, t, g, unknown or other
  misc_feature (387)..(387): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtgtcccccaggacagacggccaggatccacctgctctgcagatggactgaccaaagaaatntgcttattggtaccaacagaagccaggccacgcccctgtgttagtgatataataagacacgtgagacggccctanagagactccctagagcgtattcgtcgtggcctccgagtccgtacgacgggacagctagtctacgttnactatcagtagagtccgagcgaaggacggacgaggtctacgacttagttacgtagtaccaaacgtagtagacgtagtagtacgtactcgtagtttgggtggttacggacgggtaggaccgtagcgtacggaccgtcgtagtccgacgacccaggccctcgcccccgttcgg

SEQ ID NO: 201288 - DNA, 729 bp, Homo sapiens
  misc_feature: GYAE6OF01C6MAW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacgaggctctggacggtccctcctatggacgctgacacacgccctacccgtcggtgtcagtcgcccaggaccgaacggccaggactcacctgctcgtaggatattctagttacgaactaaaagattattacgttggttcggtaccagcgaagtagtacgacggccaccggtccctaggtacgtggactactccgaagtcggacggtccgaggtccggaaccgtacctacggtaccgggaactccgaggacgaagttcttctctcgtcctaccgagtccgtacggaacgggcctaggtcccgaccttacgttagaccttaaggtccggaacggggtccgggacccgtagggtacggacgtagtagacgcttagtaccttagttacgttacggtacgacctaaccgtagacgtaggttaggtacgtacgtacggttacggggtaggggttacgtacgggggaccggggtaacggtaaccggttaagggttccggtacccggttacgttcggaccggtaccggacccggacgggtcccgttccccggtccccggttacgtccccgttactttccccggtccccgttcccccgtcccccg

SEQ ID NO: 201289 - DNA, 704 bp, Homo sapiens
  misc_feature: GYAE6OF01CCXJY.21.46.E02.1.454.CMB.1.raw
tcagtcgtcgctcgcacgaccggtgctcgatttagactcatctacagggaaagggggtgggtccaggaggcagaactctgggtgtctcaccatggcctggactcctctacttctccctctcactctctgcacaggctctgacggcctctatgacgctcgacacacgcctaccgtggtctcagtccgtacccgaggacacggaccggccaaggactccgaccttgccttcgtcgacgaaggacgttacggactacgaaaccaaaagtaaacttgtacgtacttttacgttacggtaaaccaacgaacggaacgaccgaacggccgaaccggtccccgttaggtacggtttaaggtagtaattaacgtaaacgtaaacgactacgtacggaacggtacggaccctagaacggtacgacttccgtagacgtacgtacgtttcgcgttcggcctacgacgccgtacggacggacacgacgtacgtaccgtacggttactaacgttagtacgtaggtaacgtaacgtacgaacggacgaacgggtacgggacgtaccggtacgtacgttaacttacgttacgtacgaaaccgtaacgtacgtaacgtacgtaagtacggtattacgtagttaggttagggtcgtacgggcggtaacggacgtaggtctacggtccgtcgtaacggcgacgaccgagctcccgaccgtcg

SEQ ID NO: 201290 - DNA, 671 bp, Homo sapiens
  misc_feature: GYAE6OF01B0159.21.46.E02.1.454.CMB.1.raw
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (355)..(355): a, c, t, g, unknown or other
  misc_feature (355)..(355): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtgtccccaggacagacggccaggatcacctgctctgcagatggactgaccaaagaaatntagcttagttggtaaccaagagaagccacgggccaacggcccctgtaggttagtgtatataataaacgactanggagaacggcctacagagttacncctaggagtccgatttcnccgttaggctaccgagtcgcgaaggggtaccaggaccaggtctaaccggttagtacctaagtcgaacggttacgaaacgttacggaaccgggagaacggggtaacggaaccggggaggtcggtaacgttaacgttaaacgtttactttaaggaacgtaaaacgtcggtaaagaccgtaagggtaagtaacgggtttaactcgtaggttcggggttaggttaccgggagggttacgggaacgtaacggtcgtacggtacccgggtcttaagggtacccacggtaccccgaaggtccgtcccgtccccggttacccgg

SEQ ID NO: 201291 - DNA, 671 bp, Homo sapiens
  misc_feature: GYAE6OF01CH2N3.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacccgtggtgtcagtcgtcccccaggacagacggccaggactcacctgctctgcagatggactgacaaaagaatntgtacttattacggtaaccaacgaagaacgaccgacggccacggcccctggttcgtagtagataataagtaaacgactacgtgagacgacccgtacaggacgtactcccgtaggactcgtacttccgtacgtcggcctaccgagcctacggacgggacaggacgtacgtacgtacgttacgtacctatacgtagtacggtaacgtcgaacggacgaaggacggacgaggtcgtagtaacgttagttacgtagtaacaaacgtaggtaacaaggttacgaaggttaacgtacgttacgtagggttacgggttcgggttacggggaccggtaaggggaaccgtaacggtaccggtaccggttaccccggttacggtaacggtacgacccggtaacccgtacggcccggttcccgtccccccggttaccgg

SEQ ID NO: 201292 - DNA, 684 bp, Homo sapiens
  misc_feature: GYAE6OF01DSCSL.21.46.E02.1.454.CMB.1.raw
  modified_base (297)..(297): a, c, t, g, unknown or other
  misc_feature (297)..(297): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtcgtcccaggacagacggccaggactcacctgctctgcagatggactgaccaaagaatagtgacttatggtaccaacagaagcaggccacggccctgtagtagtgatatagtaaacncataggagacggtccagacgagacttccgagacgtacgattctcgtggcctaccgacgtactacggacggggtaaacacggtactaacgggtactaccggttagtaaccgttagtaccgtaaggttacggaaacgttaccccggagggtaacgacggggtaaacgggacggacggtccgttaaggtaaccctttaaggttaaccgttttacggtaacaaaacggtacgtaacggtaaccgtaagggttaacggtaacggtaaccttcgtaagggttcgggttaccgggtttacggggaccgggtaacgggacctaacggtacggtaccggaccgttaccggtacgccggtacgaccggtaccggtccgtcccgtcccccgttacggg

SEQ ID NO: 201293 - DNA, 727 bp, Homo sapiens
  misc_feature: GYAE6OF01BX00L.21.46.E02.1.454.CMB.1.raw
  modified_base (297)..(297): a, c, t, g, unknown or other
  misc_feature (297)..(297): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgacttattacggtaaccaaacagaacgccaggccgacggcccctggtgttagngtatataataaagacatagagaggaccctcagagactcccgtggacgacggatttccgtcgtacgggtcttcccgaacgtccttaccggaagggacacggacgtaacgttaccgtacgtttagtaacgttaacttaccgaaggttaacggtaaacggttcccgaagggaccgaagggaacggaacggaagggtaccgtacgtaactttaacgttaacgttacgtaaaccgtaaaacgaaggttaacgtaacggtaaacgggttaacggtaacgggtttaacttacggttaggttacgggggtttaggttaccggggacggggaaccgggtaaccgaacgggttaccgtaccggtacccggttaccgaacgggttaccgaaccgggtacccgtaaacgggtcccgtaccccgggtcccccggttaacccgg

SEQ ID NO: 201294 - DNA, 747 bp, Homo sapiens
  misc_feature: GYAE6OF01EJIQ5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggaggcctctatgagctgacacagccaccctggtgtcagtcgtccccaggacaggaccggccaggactcacctgctcgtgcagatggacctgaaccaaaagaaatatcgtactttagttacggtaaccaacgaaggaacgccgacggccgacggtccccgtgttaggttaaggtgaattaagtaacgtaaaacgactacgtaggaaggaccggtacccctagaacggtaacgtaccttacccgtagacgtaccgttactttccgtcgtccggtcctaccgcggtaccgtacggaacgggaccacggacgtaagtccgtacggttacgaacttacgtacggtaagtcgtaaacgggtccgaagggtaccgaagggacggaacggtacggtactacggttaacttaacgttacgtagtaacaaacgtgtaacgaacggtaggtaagtacgttacgtacggttaagggtttggggttacgggtaccggggaacggggtaaccgggtaaaccgtacgggtaccggttacccgggttaccccggtaccggttaccgggtacccgaccgggtaaccccggacggtcccgttccccggtacccccgttcggg

SEQ ID NO: 201295 - DNA, 715 bp, Homo sapiens
  misc_feature: GYAE6OF01CTOZY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccacccgtggtgtcagtcgtcccaggacaggacggccaggatccacctgctctgcagatggactgacaaaagaatatgactttagtacggtaaccaacagaacgaccgacggccacggtccccgtagttgttagtgtaatataataaacgacacgtggaacgacggccctagagacgactaccgtaggaggtcttattccgtcgtcggtcctcgaacgtccgtacgacggggtacacggtactacggtaccgtacggttagtaaccttagtacgtaaggttacgaaacggttcccgaagggaccgaagggtaacgggaaccgacgggtactaacggtaactttaagttaaccgtagtaaaccaaacggtacgttaacggaaccgttaagggtacggtaacggtttactaacggttagggtttcggggtacgggttaccggggaacggggtaaccgggtaaccacgggttacgtaccggtacccgtttaccgggtacgggtaccgacccgggtaaccgacgggttccccgcccgggtccccgttaccggg

SEQ ID NO: 201296 - DNA, 736 bp, Homo sapiens
  misc_feature: GYAE6OF01D1O8C.21.46.E02.1.454.CMB.1.raw
tcagtcgtcgctcgcacgaccggtgctcgatttagactcatctacagggaaagggggtgggtccaggaggcagaactctggatgtctcaccatggcctggatccctctacttctccccctcctcactctctgcacaggctctgaggcctcctatgagctgacacacgcccaccctcggtgtcagtcgtccccaggacagacggccaggatcacctgctctgcagatggactgaccaaaagaatagtgtactttagttacggtaaccaacgaagaacgccgacggcccgaacggtccccttggttacggtttaggtagtaacttaattaaacgtaaaacgacgtaaccgtaggaacggtaaccggtcccctacgaaggtaacgtacctcccgtaggaacggtcgtactttccgtcgtacggtcctacccgacgtcctacgggaacgggacctacggaccgtacgttaccgtacgttacgaacttacgtacgtaggtacggtaaacgtccggaaggacgaagggtaacgggaaccggtagggtactacggttaaccgtttagtttaacgtacgtaaacgaaacgtaaggtaacgtaacgtaaggttaaggtaacgttatacggttaggttaggggttacgggtaccgggacgggaacggtaaccgtaaggtccggttacggacccgtttacggacggttaccgaaccgacccgtaacgggccttccccgggtaccccg

SEQ ID NO: 201297 - DNA, 697 bp, Homo sapiens
  misc_feature: GYAE6OF01BF3RP.21.46.E02.1.454.CMB.1.raw
  modified_base (252)..(252): a, c, t, g, unknown or other
  misc_feature (252)..(252): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacacgcccacccgtcggtgtcagtcgtccccaggacagaccggccaggactcacctgcctctgcagagtggacctgaccaaaagaaatntgtacttagttacggtaaaccaacgaagaacggaccgaagggtcccaacgggtcccccgttggttaggttaacgtgtaataagttaaactaaaggacctacgtaggaacgtaccggtccctacgaagtaacgacgtacccgtggaacgtcgtacttcgtcgtcggtcctaccgacgtcgtacgacgggactacgtcgtagtccgttagtacgacttagtacgtaggtaacgtaacggtaccgagggtaacgaagggacggaacggacggtctaagtacttaattacgtaagacctaaaagtcggtaacgaacgtaggtaaggtaacgttacgaggtttacgggtagggtcggttacgggacggggaacggaaccgtacggtccgtacggtaccgttaccggtacgtacccgacgtacccgacggtctccccgggtcccgtaccgg

SEQ ID NO: 201298 - DNA, 678 bp, Homo sapiens
  misc_feature: GYAE6OF01CB4RI.21.46.E02.1.454.CMB.1.raw
  modified_base (224)..(224): a, c, t, g, unknown or other
  misc_feature (224)..(224): n is a, c, g, or t
  modified_base (251)..(251): a, c, t, g, unknown or other
  misc_feature (251)..(251): n is a, c, g, or t
  modified_base (360)..(360): a, c, t, g, unknown or other
  misc_feature (360)..(360): n is a, c, g, or t
  modified_base (538)..(538): a, c, t, g, unknown or other
  misc_feature (538)..(538): n is a, c, g, or t
  modified_base (659)..(659): a, c, t, g, unknown or other
  misc_feature (659)..(659): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcattctctgcacaggctctgaggcctcctatgagctgacacagcccacccgtcggtgtcaggtcgtccccaggacacgacggccaggactcacctgctcngcagatggactgacaaaagaattagtntactttagttacggtaaccaaacgaaggaacgaccgacgggaccacgggtaccccttggtacgttagtagtaatataaagtaagacactagaagcggaccctagaaganactaccgtgacgtacgtaacttcgtacgtcggtcctaccgagtccgttaacggaacgggtacgacggtacctacgggtactaaccggtttgaacttacgtacgtagtaggaaacgtcggaacggacggtaaaggaggaacggagtcgtacgtacttaatacgtattaaccgaaagtanaacggataacggtaggtaacgttacgtacgttaggttgggttacggttacggacggggtacggaaccgtagtccggtaaccgtcccgttaccggtacggtacaccggacccgaacggtccncccggtcccccgttacggg

SEQ ID NO: 201299 - DNA, 822 bp, Homo sapiens
  misc_feature: GYAE6OF01DTSBD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggactccacctgcctctgcagagtggactgaaccaaaagtaatatgtactttagttacggtaaccaaacgaaggaacgcccgacggcccgaacggtcccccttggttacgtttaaggtagtaatttaagttaaagtaaaacgaacctaacgtaggaacggaacggtaccccttaacgacggtaagtaccttcccgtagacggtaccgtactttccgtcgtcggtcccttaccacggtccgttacggaacgggtaccacgtaccgtaacgttacccgtaacggtttagtaaccttacgtacgtaaggttacggtaacgttacccgaagggtacgaagggtacgggaaccggaggtaccgtacggtaacgtttaacgtttaccggtacggttaaaccaaacggtaacggtaaacggtaaccggtaagggttaacgtaacgggttaaccctttacgggttaacgggtttgggggttaccggttaccggggtaccggggtaaaccgggtaacccgtaacgggtacccggttaacccggtacccggtacccggttaaccggtcccggtaaacccgtaccccgggaaacggtccccggtcccggtccccccggttacccggg

SEQ ID NO: 201300 - DNA, 518 bp, Homo sapiens
  misc_feature: GYAE6OF01A3NRX.21.46.E02.1.454.CMB.1.raw
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (463)..(463): a, c, t, g, unknown or other
  misc_feature (463)..(463): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaatatgtcttattggtaaccaacagaagccaggccaggcccctgtgttagtgatatataaagacactgagaggccctnagagactccctagagcgattctcgtggctccagctcgagggacngcagtccacgttgactatcagtgaagtccaggacaggaggacgaggctgacttattacgtgtacaacgtgtaagacgagtagagtactactagtggtgtcggnggacggacgagcgtcggtaccgtcgtagcgtacgccgaagcgtcgccccgtccgg

SEQ ID NO: 201301 - DNA, 253 bp, Homo sapiens
  misc_feature: GYAE6OF01ARDS6.21.46.E02.1.454.CMB.1.raw
  modified_base (244)..(253): a, c, t, g, unknown or other
  misc_feature (244)..(253): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttccctcgtctctactgagcgggctggcaaggcgcatagnnnnnnnnnn

SEQ ID NO: 201302 - DNA, 610 bp, Homo sapiens
  misc_feature: GYAE6OF01BDBS5.21.46.E02.1.454.CMB.1.raw
  modified_base (340)..(340): a, c, t, g, unknown or other
  misc_feature (340)..(340): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgtacttattggtaccaaacagaagccaggccaggcccctgtgttagtgatatataaagacactgagacggacctcgagagactccctagagcgtattcncgtgcctccagctacgagacgagacagtacgtacgttgtaactagtcgagtcgtaacgtccgaaggacgagagggacgaggtacagtaacttatacgtagtaacgaaacgtaagtaacgacgtaagtaacggtaagttactacgttaggtttggggtacggtttacgggacggggtaacgggtaaacgacggtacgtacggtaccccgttaccgtacgggtacccgaaccgaccccggaaacgggtccctcccggtcccccggttaccgg

SEQ ID NO: 201303 - DNA, 678 bp, Homo sapiens
  misc_feature: GYAE6OF01DFE8M.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctcggtgtcagtcgtccccaggacagacggccaggactcacctgctctgcagatggactgaccaaagaaatntgctttatcggtaaccaacgaagaacgccgaggccacggcccctgtagttagtgaataataataagacacgtgacgacggtccctagaagacgtactccccgtagacgactacgttctcgtacggtcctccgagtccgtacgacgggtacgacgtcgtaacgtaccgtaaccgtttgaaccttacgtacggaggtaacgtaacccggtcgacggaacggtaaggaacggacggtacgtacgtacgtaactttaacgtaacgtataaacctaaaggaagtaagaacgtaagggtacgttaacggtacttacggtaggtttacgggtacggttacgggaccggaacgggtaaccgaacggttggtacccggttacggtaaccggttagaccggaccgtaacggccggtacccggtccccgtacccggttaccccgg

SEQ ID NO: 201304 - DNA, 726 bp, Homo sapiens
  misc_feature: GYAE6OF01CA6AG.21.46.E02.1.454.CMB.1.raw
  modified_base (253)..(253): a, c, t, g, unknown or other
  misc_feature (253)..(253): n is a, c, g, or t
  modified_base (356)..(356): a, c, t, g, unknown or other
  misc_feature (356)..(356): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgccaccctcggtgtcagtcgtccccaggacacggacggccaggactcacctgctctgacgagatcggactcgaaccaaagtaaactntgtactttagttcggtaaaccaacgaagaacggtaccgacggaccgaaccggtccccgttggttagttagtacgtaaatactaaagtaaacggaccttaacgngaacggaccgtcccacgaggaatacctccgaggtacacgtacttctcggtcggacctcgactcgccgaaggacacgtanaacgttccgaagttcgtaactacgatagtacgaacgtacgacggacgaagggtacgaacggtacggatacgtaacttaacgttaacgtaagttaacgaaaaccgtggttaaacgaaccgtaaggttaaacggtacggttaaccgttacgttaggtttacgggtacgggtttaccggggaacgggttaaccggggaacgtaacggtaccgttaacgggtaccccgttaccgggtaaccggtaccgtacccggacccgtaacggtacccgttccccggccccggttaacccgg

SEQ ID NO: 201305 - DNA, 1018 bp, Homo sapiens
  misc_feature: GYAE6OF01DZZ0I.21.46.E02.1.454.CMB.1.raw
tcagtcgtcgctcgcacgaccggtgctcgatttagactcatctacagggaaagggggtgggtccaggaggcagaactctgggtgtctcaccatggcctggactcctctaccttcctcccctctcactctctgcacgaggctcgtgacggcctcctatggacgctacgaccacacgccctacccgtggtcgtcgacggttccgaccccgaggaccgacggaccggaccgaagggtacctaccgaccgttcggtcctttcgacgaccgtaaggtaaggttaccgggaaccttaacggaaaaccgtaaaaaacggttaattaacgttcgttaaccgttttaacggttaacggtaaaccccaaaggaacgaaaccggtccgaaccgggtaacccgtacccggttacccgttaggtttacgttaaggtacgtaaaactttaaacggtaaacgtaaaaccgtaccgtaacggtacggaaaccggtcccggttaaccctaaggaagggttaccgtaacccgtacgtcgggtaaaccggtctttaacgtttccgtaccgggtcggtacccctaccggtacggttaacccggacggggtaacgggtaaccgaacgggtaccgtttaacgtacccgttaaggtttacgtaaccgttaacggttaaggtacggtacgtaaccgggttacgaaacggtaacggaacggggtaaccggggtaacgtacggtaccgttaacgggttacctttaaacggttacccggttaacaacggtaaaaccgttcgggaaacttacggtaaaccgggggtttaacggaacgttttaacggtaggttttaccggggggtttaagggttacccggggttaacggggggaaccgggaaaacccgggttaacggtaacccgttaccgggggtttaacccgaaaccgggtttaccccgggtaacggtaacccccggggtaaaacggcccccggtttaaacccgggggccccctttccccccgggggtacccgttttaaccccggg

SEQ ID NO: 201306 - DNA, 812 bp, Homo sapiens
  misc_feature: GYAE6OF01CMW7Q.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctcccctctcactctctgcacaggctctgacggcctcctatgagctgacacacgcccacccgtcggtgtcagtccgtccccgaaggacaggaccggccaaggatccaccgtgctctcgcagagtggactacgaacaaaaaggaatattacggtactttacgttacggtaaccaacgaagaacgaccggacggacccgacggtccccttaggttaggttagtagtaattaataagttaaaacgaccgtaagtaggaacggaccgaccctagacgacgtacgtcccgtaggacgtaccgtattcgtacgtcgtcctccgacgtccgtacgacggggtacagtacgtacgttaccgacggttacaacgttagtacgtacgggttaacgaaccgtccgggaaggtacggaacgggacgggtaaacgggtcgtaccgtacgtaaacctttagttaaacgttacgtaaacgaaacggtttaacgaaacggtaaggttaacgggtaaacgggaacgggttttacctaacgggttttaggggttcgggggttaccgggttaccggggggaaacggggaaaccgggttaaccccgtaaggggttcccgaaccgggtttacccccggttacggtaacccgggggtacccaaccccgggtaccggaacccgggttcccccgtccccgggttccccccgggtttaacccg

SEQ ID NO: 201307 - DNA, 741 bp, Homo sapiens
  misc_feature: GYAE6OF01DLO3N.21.46.E02.1.454.CMB.1.raw
  modified_base (231)..(231): a, c, t, g, unknown or other
  misc_feature (231)..(231): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctagacacacgccctacccgtggtgtcagtcgtccccgaggaccaggaccggccgaggactccacctgcttcgngacagagtcggactcgaacaaaagtaatagtcgtactttagttacggtaaccaacgtaaggaacgaccgacggacccgaacggtccccttaggtacggttaacgttgaagttaattaaagtaaacgacctaacgtagaacggaccggtaccctacgaacggaacgtacccgtaccggtacggaggtaccgttaacgttttccgtcgggtaccggtcccttaccggacgttaccgtaccggaacggggtaccaacggtacgtacgtaccggtaacggtttacgaccgttacgtaacgtacgggtaaggtaaccgtaccgggtaaggacgaacggggtaacggacgggacggtaacgtacgtaacgttaacgtttcgtaagtaaccgaaacgtagtaacggtataaggttacgtaagtaccgttaggtaggtttcgggtggtaccgggcggaacgggtacgacgtcgtacgtccggtacgtacgacgaccgactacgccgtccgcccgtacg

SEQ ID NO: 201308 - DNA, 774 bp, Homo sapiens
  misc_feature: GYAE6OF01BOVKJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacgcaggatcactgctctgcagatggactagaccaaaagtaatatgtacttagttacggtaacctaagaagaacgaccgacggacccgacggtccccgttaggtacgttacgtgtaaataagttaaacgtaaaacgacgtacgtacggacggacggtccctacgagtacgtactcccgtagacgtaccgtacttccgtccgtcgaccgttaccgacgtccgtacggaacgggacacggtacgtaggtaccgtacgttacgtactaaggtacgtaaggtaccgtaaaggttacccggaacgggacggaaacgggtaacgggaaccgtacgggtacgttaaccggttaacgttaaccgtttaacggttaacgtaaacccgtaaacggtaaggttaacgaacgggttaaaggttaacggtaagttacggttaccgttaagggtttcggggtaccggttaacggggtacggggaaaccggtaccgtaaacgggtccgtaaccgggttaaccgcccgggtttaaaggcccgtaaacccgggcccgtaaaccgggtcgttccccccgggtcccgttaacccggg

SEQ ID NO: 201309 - DNA, 656 bp, Homo sapiens
  misc_feature: GYAE6OF01BK992.21.46.E02.1.454.CMB.1.raw
  modified_base (245)..(245): a, c, t, g, unknown or other
  misc_feature (245)..(245): n is a, c, g, or t
  modified_base (330)..(330): a, c, t, g, unknown or other
  misc_feature (330)..(330): n is a, c, g, or t
  modified_base (387)..(387): a, c, t, g, unknown or other
  misc_feature (387)..(387): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagccaccctcggtgtcagtcgtccccaggacacggaccggccaggactcacctgctctgcagatggactgaccaaagaatntgacttattcggtaaccaacaagaacgccaggccacggtcccctgtcgttagtcaatataataaagacacgtgagacggccctanaagagactcccgtagacgcgtacttctcgtcggcctaccgcgtcctacggaggaccngactaacggtctaacggttcgaacttacgtcgtaagtacggtaacgtacccgaagggaccgaagggtacgggacgacgggtactagtacgtaacttacgtacgtaacaaacgtaacgtaataaaccggtagtacgtaaaggttacctaggttaacgggtttgggttacgggttccgggacgggtaaccgggacgtaacggtccggtaacggtccggttaccgtaacggtccgaacgacccgaaggtccctcccggtaccccgttcccgg

SEQ ID NO: 201310 - DNA, 846 bp, Homo sapiens
  misc_feature: GYAE6OF01AV28X.21.46.E02.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccacccgtcggtntcagtcgtccccaggacagacggccaggactcacctgctctgcagatcggactagaccaaaaagtaactatcgtactttaagttacggtaaccaaacgaacggaaacgccgaacgggacccgacggtcccccgttaggttaggtttaacggtaggtaacgttaaattaaaacgtaaaaacggtaacctaaacggttagggaacgggtaccgggtacccccttaagaacgggtaacgtaccttccccggtaagtaacggaccgtttacgttttacccgttcgttacgggtccccgtttaaccacgggtaccttaacgggaacggggtaaccgaacggtaccgtacggttaaccgtaacgggtttaacgtaaccgttaacgtaccggtaaacgggttaggaaacccgggttaccggaacgggtaacgaacggggaacggtaacggacgggttactaacggtaaacgtttacgttaaccgtagtaaaccgtaaacgtaaggtaacgaacggtaaggtaaggtaacggtttacgtacggttagggtttacggggtacgggtaccggggtacggtaaagggaaccctaacgggttaccgaccgggtacccgttacggtaaccgacggtacccggaacggacccgtccggttaccccggccccgttaaccgg

SEQ ID NO: 201311 - DNA, 729 bp, Homo sapiens
  misc_feature: GYAE6OF01DMRU6.21.46.E02.1.454.CMB.1.raw
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
  modified_base (244)..(244): a, c, t, g, unknown or other
  misc_feature (244)..(244): n is a, c, g, or t
  modified_base (309)..(309): a, c, t, g, unknown or other
  misc_feature (309)..(309): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtcccaggacaggacggcaggatcacctgctcngcagntggactgaaccaaagaaatntgtacttagttacggtaaccaacgagaacgccgacggccacggccctgtgttagtgaataataanaaaggacacgtaggacgtacggccctagaaggacgtacctacccgtaggacgtaccgtatttccgtcgtcggtcctaccgtaacggccgtacggaacggggaccacgtacgtacgttacccgtaacgtttacgtaacttaacgtacgtaacggttacggtaaaccggtaccggaacgggaacgaacgggaacgggaccggtagggtaccgtacgtaacgttaactttaacgtaggtaaacctaaacgtaacgtaacgtaacgtaaggtaaggtacggtaccgttaaggttagggtttacggggtacgggttacggggacgggtaccgggtaacgtacggtaccggtaccggtaacccggttaccgttacgggtaccgtacggtacccggtacggaaccgtcccggtccccggttccccgg

SEQ ID NO: 201312 - DNA, 827 bp, Homo sapiens
  misc_feature: GYAE6OF01ALKJL.21.46.E02.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacacgacggccaggatccactgctctgcagntggactgaccaaagtaatatgtcttagttacggtaaccaagagaacgccacgggccacggtcccctaggtcgttagtgtataagtaataaagacctaacgtggaacgtacggtccctagagtaacgtacctaccgtgaacgtcgtacttccgtcgtcggtccctaccgacgttccgacggtaacgggaccgacgtaccgtaacggttcccgtaacggtttacgaccgttaagtaaccggtacggtaacggtaacccggttaccccggaaaggggtaccgaacgggtaacggggaaccgggaacggggtaccttaacggttaacgtttaaccgtttaaccgttaacggtaaccctaaaaacggttacggtaaacgggttaaccggtaagggttaagggttaaaccggttaaccttacggggtttaacgggttttacgggggtaccggggtttaacggggacccgggggtaaaacggtaacccggttaacgggtccccgttaaccggggttaacccccggtttaacggttacccggtaacccggaacccgggtaaccccggtaccgggttacccggtaccccccggttcccccggggttaccgg

SEQ ID NO: 201313 - DNA, 627 bp, Homo sapiens
  misc_feature: GYAE6OF01AZ6J1.21.46.E02.1.454.CMB.1.raw
  modified_base (210)..(210): a, c, t, g, unknown or other
  misc_feature (210)..(210): n is a, c, g, or t
  modified_base (221)..(221): a, c, t, g, unknown or other
  misc_feature (221)..(221): n is a, c, g, or t
  modified_base (585)..(585): a, c, t, g, unknown or other
  misc_feature (585)..(585): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccagganccacctgcctntgcagagtcggactcgaaccaaaagaaacttatgtacttaagttacggaaccaaacgagaacgaccgacggccgacggtcccctggttaggttagtagaattaataaataaacgacacgtagacgtacggccctagagacgtactccgtaggacgtccgtactttccgtacgtcggtccctaccgtacggtcctaggacgggactacggtaccgtagtaccgtacgttacgtactacgacgtaggtacgtacggtacgagggacagggacggacgagtacgtacgtacgttatacgtactacgaaagtgaacgtagagtagtacggtactcgtaggttgggtacggtcgggacggaagcgacgngtacgcgttacgacgacgcgaccgagtccgccgtcccggtcg

SEQ ID NO: 201314 - DNA, 733 bp, Homo sapiens
  misc_feature: GYAE6OF01CTCEY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctctatgagctgacacacgcccacccgtggtgtcagtccgtacccgaaggaaccaaacggcagactcacctgctgtggatacttactatacgaacaaaagtattacttagttggttcgtacagacgaagaagtcgacgaccgtaccggtccctagttacgtcggtacacgtacctagtacggacgtaccgacggtaccgaaccgaccgtcggtacccgggacttcccgaggaagtacgttactttccgtaccgtacgtccccgtacgtacgcgtacggaacgggtactacggtccggtaccctacgttagacttacgacggtacgggggcggtacccggagggtacggaagtagtacggtaacgtaccgtacggtaactttaacgttaggtttaaccgtaccgaaccggtaacgtaacggttaaggtacgggttcgggtactacggtaacgggtaggggtaggggtaccgttacgggacgggacgtaaccgttagggttcccgacgttccgtacggtacgaacccgcggacggtccccggaccttccccggtcggacttaccgtcccgtccccgttccctccccg

SEQ ID NO: 201315 - DNA, 747 bp, Homo sapiens
  misc_feature: GYAE6OF01CSZYY.21.46.E02.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctctgcacaggctctgacggcctcctatcgagctgacacacgccacctggtntcagtcgtcccaggacacggacggccaggactccaccgtgcctctgacgaagagtcggactacgaaccaaaagtaatgtagttactttaacgttacggaaccaaacgaacggaacgccgaacggccgaccggtaccccgttaggttacgttaaggtgtaataagtaaagtaaacgactacgtagacggacgtcccgtagaagaacgacctaccgtagacggctacgttctcgtcggacctacgacgtccgtacggaacggacacggtcgtacggttacacggttcgtaacttacgtaccgaagtaccggtaacaccgggtaaggacggaaaacggtcgggaacgacggttaccgttaacggtaagtttaaccttttaacggacgtaaaacctaaggaacggtaacacggtaacgtacgggtaacgttactaccggttggggttacggtacgggtaacggggtccggtaaaggaacccgtaacggtacttacccggaccgggtttaaccgtagtacccggaacccggtaaccgggtaccgtcccgggacccgttcccccgtaaccggg

SEQ ID NO: 201316 - DNA, 619 bp, Homo sapiens
  misc_feature: GYAE6OF01APPKH.21.46.E02.1.454.CMB.1.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtcccaggacagaccgccaggactcacctgctctgcagatggactgaccaaagaaatntgacttattggtaaccaacagaacgccaggccaggcccctgtcgttagtgatatataagacactgagaggccctanagagactccgtgacgcgtacttctcgtcggacctccgtacgcttacgacggggacaggcaacggttctacgttagaacttactacgaaggttacgaacgttaccgaacgggcgaagggtaaggacgaggtcctagtacttaacgttacgtgtaaccaaacgtaagtaaggaacgtaggttaacggaggttaaccttgtaagttggggtacggtcggtacgggaacgggtaaccgacgtacgtacggtcccgtacggtacggttacgacggtacccgtaaggcccttccggcccccgttacgg

SEQ ID NO: 201317 - DNA, 638 bp, Homo sapiens
  misc_feature: GYAE6OF01AJQQJ.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctgcagatggactgaccaaagtaatntgcttattcggtaaccaacagaacgccagggccacggcccccttggtgttagtggaattaactaataaagaccacgtggaagacggcccctagaggacgtactcccgtagacggtcgtactttctcgtcggcctccgaagtcctacgaacggggtaccaggacgtacgtccgtacggttacgaacttacgtactaagggtacgtaaccgtacccggacgggactaagggacgggacgacggtctacggtacttacttaacgtgtaaccaaacgtaggtaacgacgtaagtagtaggtactcgtaggttgggtcgttcgggaggtacggacgacgtacgacggtcccgtacgtacggacgtaccggaccgaacggcccgtcccgccccggttaccgg

SEQ ID NO: 201318 - DNA, 823 bp, Homo sapiens
  misc_feature: GYAE6OF01A557L.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccacccgtcggtgtcagtcgtccccaggacagacggccaggatcacctgctctgcagatggactgaccaaaagtaaatatgtacttagttacggtaaccaaacgagtaacgccgacggaccgacggtccccctggttcgttagtcgtaatacgtaataaacgacctacgtagaacgtcggtacccctgaagacgtacttcccgtaggacgtacgtactttcctcggttacgggtccctccgtaacgtccgttacggaacgggaaccgtagggccgtaacgttaccgtaacggtttacgaaccgttacttaccggtaaggttacggtaaaaccggttcccggaaagggtaccggaaagggtaaaccggggacgggtaacgggtaccgttaacgtaaccgtttacgtttaaaccggttacgtaaaccgtaaaacgtaacgggtaaacggtaaacggttaacggttaacgggttaacggttaaccgttaggttaaccgggtttgggggttacggtttacggggtaccggggtaacgggtaaacccggtacgggttcgtaacccggggttaaccccgttacccgggttaacggtacccgtaaaccggggtaccccggttaaaccggccccggttacccggttcccccccggttaacccggg

SEQ ID NO: 201319 - DNA, 712 bp, Homo sapiens
  misc_feature: GYAE6OF01BLUI8.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctctatgagctgacacagccaccctcggtgtcagtcgtccccaggacagacggccaggatcacctgctctgcagatggactgaccaaaagtaatangtcttattggtaccaacagacgccgaggccaggcccctgttcgttagtagattaataataacgacacgtgacgacggtcccctagacgagtacctcccgtaggacgtcggtactttccgtcgtcggcccttaccgacgtaccgttacggaacggggaccgaacgtcgtaacggttaccgtaacgtttacggtactttagttaccggaaggttacggtaacgttcccgaacgggacggaaggacgggaacggaccggttacgtagggtaaccctttagttaacggtacgtaaaccgtaaacgtacgtaacgtaaccggtaagtaacgggtaacggtttaaccctagggttaggttaccggggttgggttaccgggacgggtaaccgggtaaccgtacggtacccgtcgggtaaccccgttcggtaaccgtcggtacccggaccgtaacgcccgtacccgtccccgtaccgg

SEQ ID NO: 201320 - DNA, 726 bp, Homo sapiens
  misc_feature: GYAE6OF01DNM11.21.46.E02.1.454.CMB.1.raw
  modified_base (142)..(142): a, c, t, g, unknown or other
  misc_feature (142)..(142): n is a, c, g, or t
  modified_base (244)..(244): a, c, t, g, unknown or other
  misc_feature (244)..(244): n is a, c, g, or t
  modified_base (273)..(273): a, c, t, g, unknown or other
  misc_feature (273)..(273): n is a, c, g, or t
tcagtcgtcgctcgcacgaccggtgctcgatttagactcatctacagggaaagggggtgggtccgaggaggcctaggtaactctgggtgttctcaccagtggcctggatccctctacttctccccctcctcactctctgcanaggctctgaggccctacctatgagctagacacacgcctaccgtggtggtcagtcgtcccgaggtaccagacggcctaggtactcacctgacttctgacgagngtaggactacggaaccgtaaaagaaggtntcggtactttagtacggtaaccaagaagaacgccgacggccgaaccggtcccgttggttagttagtacgtaattacgtaacgtaacgtacctaacgtacggtaacggaccgtacccgtagaagtacgtaccgtccggtaggacgcgttaacgttcccacggttcggaccgtacgacggttaccgacggtaacggggactacgggaccttcggtaccgttacggttacgtacgttacgacgtaacgttaagaccgtacggacgacggtaaggaacggacgacgtacgtacgtaacgttacgttagtacgaacctaagtacgaactagtaaggttacgtagttactattacgggttacgtacggttaccggacggtaacgtaacggcgttacgacggtaccgttaacggtacggtaccgaccgtaccgaccgtccgtacccggtccccgtaccgg

SEQ ID NO: 201321 - DNA, 704 bp, Homo sapiens
  misc_feature: GYAE6OF01CPJWM.21.46.E02.1.454.CMB.1.raw
  modified_base (229)..(229): a, c, t, g, unknown or other
  misc_feature (229)..(229): n is a, c, g, or t
  modified_base (357)..(357): a, c, t, g, unknown or other
  misc_feature (357)..(357): n is a, c, g, or t
  modified_base (456)..(456): a, c, t, g, unknown or other
  misc_feature (456)..(456): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctctgcacaggctctgacggcctctatgagctgacacacgcccacccgtggtgtccagtccgtccccgaggacgacggaccggccaggactccactgctcngcagatcggactagaacaaaagtaatagtcgtacttagttacggaaccaagaagaacgaccgacggcctaccggtccctaggtagttaagtagtaataattaaagaaacgacctagacgaacggaccnccctaagaacgacgtacctaccggtagagtcgttacgttcgtacggtcggaccttacgacgtaccgaggaacggacacgtacgtacgtacgtacgttanacctagtacgaggtacgaacgcgagacgaagggtaggacgggacgtagtaacgtaccttagtaaccgataaaccgaaagtgttaacgaggtaaagtacgtacgttacttaggtacgggtttaggggtccgtacggggaacgggtaaccgtaaacggtacgtaccggttaacggtcccgtttaacggggtacgaacccggtaacccgggaccgtaaaccggtccgttcccccggtccccggttacccgg

SEQ ID NO: 201322 - DNA, 592 bp, Homo sapiens
  misc_feature: GYAE6OF01C6UJ9.21.46.E02.1.454.CMB.1.raw
  modified_base (432)..(432): a, c, t, g, unknown or other
  misc_feature (432)..(432): n is a, c, g, or t
  modified_base (489)..(489): a, c, t, g, unknown or other
  misc_feature (489)..(489): n is a, c, g, or t
  modified_base (499)..(499): a, c, t, g, unknown or other
  misc_feature (499)..(499): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaaagaaatatgtactttattacggtaaccaacgagaaagccgaagggcccaacgggtccccctggtagtttaggtagtaataataaattaaaacggaaccactgaaggacggtcccctacaaggagactccctaggacgtcgtaatttcctacgtacgggcctacccagccgtacgaaggggacacgtacagtcagttanactatacgagtgtaagtccgaggacgagaaggacgaggctagactaatactacgtanaacgaagtanacgaagtaagtaggtatcgtaggttgggtgtcgggacgggaggaccgaagtcgagtccgtactaggtacgcgacgacgcgtccgccccgtcgg

SEQ ID NO: 201323 - DNA, 709 bp, Homo sapiens
  misc_feature: GYAE6OF01BO4DY.21.46.E02.1.454.CMB.1.raw
  modified_base (179)..(179): a, c, t, g, unknown or other
  misc_feature (179)..(179): n is a, c, g, or t
  modified_base (367)..(367): a, c, t, g, unknown or other
  misc_feature (367)..(367): n is a, c, g, or t
  modified_base (497)..(497): a, c, t, g, unknown or other
  misc_feature (497)..(497): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccacccgtcggtntcagtcgtccccaggacagacggccaggatcacctgctcgtgcagagtggactgaccaaaagaaattagtcgtactttagttacggtaaccaaacgaagaaacgccgaacgggccacggtccccgttaggttcgttaaggtagtaattataaagttaaagactaacgtaggaacggaaccgtccctanaaggacgtactcccgtagagtcgtacttccgtacgtcggccttaccgagtcgtacgacgggacacggactagtacgtacgttagactagtacgtaggtacgacgtacgaaggcgaaggaggacgacggtntagtaacttagttaacgtataacgaaacgtaggaacgtaacgtaaggtaaggtaacggtttactacggttaggtttcggggttaacggttacggggacgggtaaccggtaaaccggacgggttcgtaaccggttacccgtacggttaaacccgggtccgaacccgggtacccgaaccgggttccccgtacccggtcccccggtttacccggg

SEQ ID NO: 201324 - DNA, 639 bp, Homo sapiens
  misc_feature: GYAE6OF01B6RDV.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtcgtccccaggacagaccggccaggactccacctgctctgcagatggactgaccaaagaaatntgtcttattaggtaaccaacaagaacgccaggccacggcccctgtgttagtgataatataaagacacgtagagacggcccctagagagactccccgtagagccgtattctcgtggctccagcctcgaggacagcacgtctacgttgactatacgtagtagtaacgtcgagtcaaggaggacgaggcttagacttagttactgtaactaacgtaggtaacaacgtaggtaaggtacgttactaaccgtaggtttacggggtggttaccggggtaacggaaccggggtaaccgaacggttcggttacccggtaacccggttccgttaaacgggtcccgaacgggtaccccgaaaccgggtccccggttaccccggtcccccccggttacccggg

SEQ ID NO: 201325 - DNA, 689 bp, Homo sapiens
  misc_feature: GYAE6OF01DEIYD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatccacctgctctgcagatggactgaccaaagaatatgactttaattacggtaaccaacgagaacgccgacggaccacggcccctaggtgttagtgtaataataagtaaacgtacacgtaggagacgtccgtagagacgtacctaccgtaggacgtcgtactttcctcgtacggcccttaccgacgtccgtacggaacgggaccaggactacggtacgtacgttacgaacttacgtacgtaagtagtaacgtaccggaggtacgaacggacgggacgacggtactacgtaacttaagttacgacgttaaccaaaggtaagtaacgtaacgtaagggttacgtaacgggttacttacggtaggtttacggggtacggtacggggacgggtaacggaacgttaacggccggttaccggtacccggttaccgtaaggtaccgaaccggtacccgacggtcccgtacccggtcccccgttacccgg

SEQ ID NO: 201326 - DNA, 861 bp, Homo sapiens
  misc_feature: GYAE6OF01EYZFR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgtacttaagttggtaaccaacgaagaacgccgaggaccacggtccccgtgtagttacgtagtatataagtaaaacgactactaggacggacggtaccctacaaggacgtacgtcccgtaggtaacgccgttaatttccgttacgtacgggtacccttaccgacgtcccgttacggaacggggtaaccgacggtaccgtacgtaccgtaacgggtttacgtaaccttaacggttacgtaacgggttaacggtaaaaccgggtttaccgggaaacggggtaaccgaaacggggtaaaacgggggaaccgggtaacggggttaccgtttaaaccgtaaacgtttttaaaccgtttacggtttaaacccggtaaaaccgtaaaaacggtttaacggggtaaacggtaaaccgggtttaaagggttaaaaccggggttacggtttaaaccgtttacggttaaggggttttacggggttaccggggtttaaccgggggaaccggggtaaacgggtaaccccgggtaaggttccggtaaaccgggtaccccggtaaccgggtttaacggaccccgaaacgggttaccccgaaaggttccccggtcccgtccccccgggttaccgg

SEQ ID NO: 201327 - DNA, 707 bp, Homo sapiens
  misc_feature: GYAE6OF01DNMYR.21.46.E02.1.454.CMB.1.raw
  modified_base (138)..(138): a, c, t, g, unknown or other
  misc_feature (138)..(138): n is a, c, g, or t
  modified_base (565)..(565): a, c, t, g, unknown or other
  misc_feature (565)..(565): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctctgcacgnggctctgacggcctctatgagtctagacacacgccctacccgtggtatcgacgtcgtacccaggacacgaccggccaggactccacctgccttacgagacagtacgtacggaacctacgaaaccgaaaaagtaaagttcttaggtacctttaagttaacggtaaccaacgaaggaacgtaccgacggaccgaccggtccccgttaggttacggttagtaagtaattaataaagtaacgaccaagtgaaggtacgaccctagaagactaccgttaccaggacgtactatttccgacgtcggacctacgcgacctacggaagtacacggtacgtacgttaccgaacgtttacgtaactacgtacgtaaggtacgtaaccgtacggaacggagaacggacgggacgtaacggtcgtaactaacgtttaanaacccgttaggaaacctaaacggttgaaaccggtagtaaaggtacgttacgaaccgttagttaggtggttacgggtcggaacggtagaacgtgacgtacgtaccgtacgtagacccgacgacgaccgccgttccgcccgtcg

SEQ ID NO: 201328 - DNA, 544 bp, Homo sapiens
  misc_feature: GYAE6OF01CJ620.21.46.E02.1.454.CMB.1.raw
  modified_base (282)..(282): a, c, t, g, unknown or other
  misc_feature (282)..(282): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatgcttatggtacaacagaagccaggccaggcccctgtgttagngatatataaagacactgagaggccctagagagactcccgtgaagccgtaattcctcgtggcctccgagctcgaaggggacagcgagtcacgtgactatcagtgagtcgagcaagagacgagctagactagttactagtaacaaacgagtaagacgaagtacgagtactacgagtttgggtgttcgggaggacgggtaccaaggtcgtcgaccggttaccgtaggtacacggtacccgaaaggcctccggccccgttaccggg

SEQ ID NO: 201329 - DNA, 551 bp, Homo sapiens
  misc_feature: GYAE6OF01BU55J.21.46.E02.1.454.CMB.1.raw
  modified_base (401)..(401): a, c, t, g, unknown or other
  misc_feature (401)..(401): n is a, c, g, or t
  modified_base (455)..(455): a, c, t, g, unknown or other
  misc_feature (455)..(455): n is a, c, g, or t
  modified_base (469)..(469): a, c, t, g, unknown or other
  misc_feature (469)..(469): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtggtgtcagtcgtccccaggacagacgccaggatcacctgctctgcagatggactgaccaaaagaatatgcttattcggtaaccaacagaacgccaggccacggccccctgtgttagtgatataataaagacacgtgagacggccctagagacgactcccgagacgcgtattctcgtcggcctccgacgcgtcgaacgggacagcgagtcgtacgttgactatacgngtagacgtccgaggcagaggacgagcgtagactattactgtacaagagtaaganaggtagtagtacgngtagtgggtagtcgggcggacggtacgacgtgtacggtccgtaccgtaggacgtacgacccgagccgtccgccccgtaccgg

SEQ ID NO: 201330 - DNA, 1041 bp, Homo sapiens
  misc_feature: GYAE6OF01EDLR9.21.46.E02.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccaccgtcggtgtcagtcgtaccccaggacagaccggccaggactcacctgctcngcagatggactgaccaaaagaatatgtacttacgttacggtaaccaaacgacgaacgaccgacggacccgacggacccccgttgtacgttaggtaggtaataagtaaacgttaaaacgaaccacgtacggaacggaccggtcccttagaacggtaacgtaccttaccccgtaggaacgtcgtaacttccgtcgtcggtcctacgacgtaccggtacggtaacggggaccctaaggtaccgtaacgggttacccgtacgggtttaccgtaaaccgtttacgtaacccggtaacgggttaacggggtaaacccgtttacccgggaaccggggtaaccgtaaccgggggaacggggtaacccgggttaacggggtaacccgtttaaccgggttaaaaccggttttaaccggtttttaaaccccggtaaacggggtttaaaacccccgtaaaaacggggttaaacccggttttaaaccgggaaaccggttaaaaccggggggttaaacgggttttaaaacccggggtttaaacccgtttaccggggttttaaacgggggttttaccgggggggtttacgggggttttaaacccggggggaaccccgggggtttaaaaccggggggtaaaccccggttaaacccggggtttaaccccgggtaacccccggggttttaaacccccgggtttaccccggggttaaaccccggggggttttaaaccccgggaaccccgggggttaaaccccccggggtaaaccgggggtttccccccgggtttaaccccccgggttacccccccccggggtttttaaaccccggggg

SEQ ID NO: 201331 - DNA, 883 bp, Homo sapiens
  misc_feature: GYAE6OF01DMI2Z.21.46.E02.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (685)..(685): a, c, t, g, unknown or other
  misc_feature (685)..(685): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtctcagtcgtccccggganaacggccaggatccacctgctctgganatgactattacgaacctaaaaaaatttgtttaggttttttacggaccaggtacaaggtaacgtacgacgggaccctaacgggtcccccgttggtggtttcgggtacctaacttcccgtaagttcgggaacgggaaaccgaaggggaaccggaacccggtacccccggttacccgggggtaaccttcccccgttaggaacggtaacggtaacttttccgtaccgttcgggtacccttaaccccgaacgttaccggaacggggggtaccgggtaccgggaccctaaccgggtttagtacctttcggtaccgtacggggtttccgggggaccccgttagggggttacggggaggggtaagtaggtaacgggtaccttaggtaacccgttaactttaccgttaacgtttacctacgaacggacgacggtaaccaggacccgtaggttggtaccgaggtttaccgggngggggtacctaggttccggggacggggtaaccgggtaaccggttgggttacccggtaacccggttcccggtaacgggttcccaaccgggtacccccgtaagggtccccgttcccccggaccccccgtttccgggttacccctccccgtttacgttacccccgtttacccccccgcccccttttcccgttaccccccgg

SEQ ID NO: 201332 - DNA, 726 bp, Homo sapiens
  misc_feature: GYAE6OF01DG4FL.21.46.E02.1.454.CMB.1.raw
  modified_base (569)..(569): a, c, t, g, unknown or other
  misc_feature (569)..(569): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacgaggctctgacggcctcctagtgagctagacacacgcccacccgtcggtagtcagtccgtaccccgaaggacacgaccggacgaggactccaccgtgcctctgacagagtcggtacacgaacaaaagtaatatcgtacttagtacgaaccaagagacgacgacggaccaccggtccttggttagtaggtactaattaaagtaaactaaacgacgaacgtacggaacggtaccgacccgtaagaacgtacgaccgttaccgaggtacgtacgttacttcgccgtacgtcctacgcgacgtacggaacgggtacaaccggtcgtacggttaacttacgttaacgaacttacgtacggtaagtacgaaccggtcggaacgggacgtaaggaacggggtactacggtagtaccgttaaagttaacttaccggttaanaaaccgaaacgtagtaacgacggtaagacgtttaagggttctaaccgggtttagggttacgggttacgggacgggacggtaacccgtaccggtatacccggtaccggtccggttacgacgtaccgaccgtacgaccgggtcctcccggtacccgtcg

SEQ ID NO: 201333 - DNA, 769 bp, Homo sapiens
  misc_feature: GYAE6OF01DA4OZ.21.46.E02.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtntcagtcgtcccaggacagacggccaggatccacctgctctgcagactggactcgaaccaaaagaaattatcgtactttaagttacggtaacccaaacgaaggaaaccgacccgaacgggacccgaccggtacccccgttaggttacggtttaaggttaggtaatttaagttaaaagttaaaacgaacctaacgttaggaacggacggaccctacgaagaacgacctccccgtaggacgtacgtaactttccgttcgtcggccctaccgagtccgtacgaacgggtacacggtaccgtagttccctaaggtttacgtaacttaacgtcgtaaggttaacggaacgtacccggtagggacgaacgggtaacgggaccggacggtaccgttaagtaccgtttaacgtttacgtaacgttaacgaaacgtaggtaaactaacggtaaggtacggtaacggttacgttaacggttaggttttggggtacggtttacgggaacggggtacggaaccggtaacgtcgtacccggttaccggtacccgttaggaccgtaccggaaccggtacggtccgtacccgtcccccggttaccgg

SEQ ID NO: 201334 - DNA, 817 bp, Homo sapiens
  misc_feature: GYAE6OF01AEGLM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccgaggacagaccggccaggatcacctgcctctgcagagtggactgaaccaaaagaaatatgtactttattacggtaaccaaacgagaacgccgacggccacgggccccttggttacggttagtgtaattaattaaataaacgactaacgtaggaaggaccggccccttagaaggacgtacctcccgtaggacggtaccgtaactttcctacgttcgggaccttacccgaggtcccttacgggaaacggggacctaacgggtccgtaacgggtttaccgtaaccgggtttacgtaaccgtttaacgttacccggtaagggttacggtaaaccgggtacccggaacggggtaacgaaacggggaaacgggaaccggggtaagggtacccgtacgggtttaaacttaacgtttaacgtacggtaaaccaaacggtaaggttaacgaaacggtagggtaaacggtaacggttacttacggttaggtttcggggttcgggtaccgggaacggggtaacgggtaaaccggtacggtccgttaaccgggtaccccgttaccgggttaacgggtcccggtaaaccggacccccggtaaagggtcccccctacccgggtccccccggtttacccggg

SEQ ID NO: 201335 - DNA, 739 bp, Homo sapiens
  misc_feature: GYAE6OF01BQ5ZU.21.46.E02.1.454.CMB.1.raw
  modified_base (248)..(248): a, c, t, g, unknown or other
  misc_feature (248)..(248): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgcccacccgtcggtgtcagtcgtccccaggacaggaccgcgaggactccacctgctctgcagagtggactcgacaaaagaatntgtactttatacggtaaccaacgagaacgccgaggccgtacggccccttaggtagttagtagtaactaagtaagtaaacgactaacgtggaaggtaccggtaccctagaaggacgtacctacccgttggacgtacgtacgttctacgtcggtacctacagtaccgtacgagggtaccaggtacgtacggtccgtaacggttagtaacgtactacgtaggttacggtaaccgacggtaacggacggtaacgggtaacggggacggtacgtacgtaggttaaccgttaacgttacgttaacgtaacgtaaacgtggtaaacgtaacgtaacggtaaggtaaacggtttctaggttacgggtttggggttaccggttaccgggggacgggtaaaccgggtacgtacggttaccggtaccggtacccggttaccggtaaaccggtccggaacggtaccccggaacgggtcccgtccccggtcccccggttaccgg

SEQ ID NO: 201336 - DNA, 760 bp, Homo sapiens
  misc_feature: GYAE6OF01BCHB2.21.46.E02.1.454.CMB.1.raw
tcagtcgtcgctcgcacgaccggtgctcgatttagactcatctacagggaaagggggtagggtccacggaggcgagaactcctgggtgtctcaccatggcctggatccctctacttcctcccctcctcactctctgcacaggctctgaggcctcctatgacgctagacacgacgcccacccgtcggtgtccaggtcgtccccgaggacacggaccggccgaggactcacctgctctgcagatcggactgacaaagtaactatcgtactttaagttacggtaaccaacgaggaacgaccgtacggcccgaacggtccccttaggttaccggttagtagtaacgttaagtaaacgttaaaggaccgtacggtaggaacggtacccggtacccttaggaacggtaacgacccttaccggtaggaacggtaccgtacgtttaccgtacggtcgggtaccctaccggagtccgtaacggacgggacacgtacgacgtaccgtacgttacgaacttagacgaggtacgtaacgtcgaaggtacgaagggaacggacggtacggtactacgtacgttaacgttaccgtacggtaaaccaacggtagtaaacgtacggtaagttaccgggtaacttacgttacgttagggttgggttaccggtacgggacggggtaacgtaaccgacggttacgtaccgtaccggttaccgtaacggtaccgtaacccggaccggtaacggttccaaccccgggttcccgttaccggg

SEQ ID NO: 201337 - DNA, 1047 bp, Homo sapiens
  misc_feature: GYAE6OF01BY82C.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctagacacacgcccaccgttcggtgtcgagtccgtaccccgaaggacgacggaccggaccgaaggactcccgtaccgtcggtccttcgtacgacgaaggtacgtacgggtaacctaccgaaaccgtaaaaagtaaacgttagtacggttacttttaacgttaccgggaaaccaaacggaacggaaccggacccggtaaccgggaccccggtaacccgggttacccccgtttagggtttaacggttttaaggtaacggttaaaagttttaacgttaaaaaccggttaaaacggtaacccgttaacgggttaacgggaaccgggtaaccccgggtaacccccgtaacggaaaacgggtaacgtttaccccgttaacccccggttagggaacccggttaccggttaaccgttttcccgtacgggttaccgggtacccccttaccggaccggttaacccgtaccggggaaagggtaacccgtacggtaccggttaaaccggtcccggtttaaacgggttacttaaccgttaacggttaacgggaacgttaacgggaaacccgttacgggaaaccgggaacgtaaacgggggaacgggtaacccgggtacggtacgtttaaaccgtaaacgttttaaccgttaaccggtaacgtaaaaccgtaaacggtaggtaaacggtaacgtaacgggttaaacgggtacgtttaacccgttacgggtttaaggggttccggggtttacgggtaaccgggggaaccggggttaaacggtaaccccggtaacggttacccggtaacgggttaaccccggttaccgggttaacccggtacggaaacccccgggtacggttacccggggtcccgttcccccccgggttaaccccgggttcccgg

SEQ ID NO: 201338 - DNA, 785 bp, Homo sapiens
  misc_feature: GYAE6OF01EU42J.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgattttagactcatctacagggaaagggggtgggtccaggaggcagaactctgggtgtctcaccatggcctggatccctctacttctcccctcctcactctctgcacaggctctgaggcctcctatgagctgacacagtccaccctcggtgtcagtgtccccaggacagacgccaggatcacctgctcgtcgcagatggactgaccaaagaatngtcttattggtaccaacagaagccaggccacggcccctggtgttacgtgatatataaagacacgtgagacggccctacgaagacggacttcccgtaggacgtccggtatttccgttcgtagggtcccttaccgacgtccgttaccgaacggggaacctaacggtcccgtaaggttaccgtaaccgggtttactaacgttaactttccgaaggttacgtaaacccggtttacccgaacgggaacgaacgggtaacgggaaccgggtacggggtacccttaggtaacccttaagtttaaccttagggttaaaccccaaaagttaacgggtaaaccgttaacggtaaacggtttaacggtaaacggtttaaccgttcgttaaccggtttgggggttacgggtttaccgggggtaacccggggtaaccggggtaaacccgtaacgggtcgttaacccggggttaaccccggttcccgttaacgggaaccccgtaccgggtaaccccgaaagggttcccctcccgggttaccccccggttaccccggg

SEQ ID NO: 201339 - DNA, 916 bp, Homo sapiens
  misc_feature: GYAE6OF01DIBA4.21.46.E02.1.454.CMB.1.raw
  modified_base (241)..(241): a, c, t, g, unknown or other
  misc_feature (241)..(241): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacagccaccctggtgtcagtcgtcccaggacaggacggcaggactcacctgctctgcagatggactgaccaaagtaatntgtacttattcggtaaccaacagaacgccaggccaaggcccctgtgggttagtgataataataaagacatagagacggccctnagagactcccgngagcgtacttctcgtacgggccttaccgagtccttacggaacggggaccgacgaccgtaacggttccgttaacggtttacgaaacccgttttaacgtaccgttaaacgggttaacgggtaaaacccggggtttaccccgtaaaggggtaacccggtaaacgggggaaccggggtaaaccggggttaagggtaaccccggttaagggttaacccgtttaaacggttttttaacccgttaacggtttaaacccgaaaaaacggttaacggggttaaaccgaaacgggttaaacgggtttaaaggggttaaaaccgggtttaaccggtttaacccgttaacgggttttttaacggggggggttacccgggttttaaccggggggggtaaacccggggttaaccggggggtaaaacccgggttaaaaccggggtacccgttttaaccggggggttaacccccccgggtttaaccccgggttttaacggggttaaccccgtaacccggggttaaaccccccgggtaaccgggggttaccccttaccccccggggttccccccccgggtttttaaacccccggggg

SEQ ID NO: 201340 - DNA, 558 bp, Homo sapiens
  misc_feature: GYAE6OF01EEIMQ.21.46.E02.1.454.CMB.1.raw
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctgcagatggactgaccaaaagaaatatgactttattggtaaccaaactagaaagccaaggcccaaggccccctgtgttagtgattataataaaagacactgagacggcccttgaagagactcccgtgacgcgtaatttctacgtgggccttccgagctacgagggacagcagtcacgttgactatcagtgaagtccaggcagaggacgagctagactattcgtagtacaaacngtaagacagtagagtactgtagttggtgttggcgggaaggaccgaaggtcctaggacccgttaccgtaggtacgacgaccgaaacggtctcccggcccccgttacggg

SEQ ID NO: 201341 - DNA, 858 bp, Homo sapiens
  misc_feature: GYAE6OF01C0J6J.21.46.E02.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgcccacccgtcggtgctaggtcgtccccgaggacaggaccggccaggactcacctgcttcngcagagtcggactcgaacaaagaaatagtgtacttagttacggtaaccaacgaaggaacgaccgacggaccgacggtccccgtaggttacgttaggtgtaacttaattaaagtaaacggtacgacgttaacggaacggtaccggtacccctagtaacggaaccgtacgtaccccgttaggacggtaccgttactttccgtacgttcggccgttaccgacggtaccgtacggacgggaccgacggaccgtacgtaccgtacggttacgtaacgttaactacggtaaggttaacggaccgttaccggaacggtacggaaacggaccgggtaacgggacggttaccgtaacggttaacgtttaaccgtttaaccgggttaactaaaaccggtaaacgtaacgggtaaggttaacccggttaaagggttaaccggttaagggttaacccgttttaaggttaccggggttttagggggtttaaccgggttaccgggggggaaaccgggttaacgggggtaaaccccgtaagggttcccgggttaaacggtacccccgggtttacgggttaacccgaccggtaaccccgggaccgttaaaccgggtccccgtaccccggtaacccccggttcccggg

SEQ ID NO: 201342 - DNA, 504 bp, Homo sapiens
  misc_feature: GYAE6OF01AUL02.21.46.E02.1.454.CMB.1.raw
  modified_base (479)..(504): a, c, t, g, unknown or other
  misc_feature (479)..(504): n is a, c, g, or t
tcagtcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattccgtggggccagggaccctggtaaccgtctcctcacgcctcccgaccaacgggcccactcggtccttccccccgtggccgcccctcgacctcccgacggacgccaccctcccgaggacgaccacacggccggtcccgtgggccgtcgccgtcgggtacgaacggtacctaccgttcccgaggtaccgacgacgtcggacgggcgggtccgacgggtacgacgggcgccgaagtagcgnnnnnnnnnnnnnnnnnnnnnnnnnn

SEQ ID NO: 201343 - DNA, 696 bp, Homo sapiens
  misc_feature: GYAE6OF01BEWXX.21.46.E02.1.454.CMB.1.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtggtccaggaggcagaactctgggtgtctcaccatggcctggatccctctacttctcccctcctcactctctgcacaggctctgaggcctcctatgagctgacactagccaccctcggtgtcagtcgtccccaggacagacggccaggactcacctgacttntgcagatgacctgaccaaagaatntgcttagtagtaccaacagacgccaggccacgtccctgtgttagtgatatataagacacgtggacgacggcccctagaacgtacgtactccgtagacgtcgtacgttccgtcgtggtccctacgtacgtccgtacgaacgggacctacgacgtaccggtccgtaaccgttgaaccttaacgtacgtaaggttacggtaacgttcccggaagggttacgtaaggtacgggtaaccgaggtacttaacggtaacttaccgttacgttcgttaaacctaaacggtcggttaacggacgtaacgggttaaggtaacggttacttacggtaacggtttcggggtaacggttccgggagggtaccgggtaacgtacgtaccgttacggacccggtttaccgtaagggtacccctacggtaaccccgtaaccgtcccgttccccgtccccggttacccgg

SEQ ID NO: 201344 - DNA, 674 bp, Homo sapiens
  misc_feature: GYAE6OF01BEKEM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgacttatggtaaccaacagaagccaggccacggcccctgtgttagtgatatataaagacacgtagagacggccctacagagactccctggacgtcgtactttctacgtcgggacctccaacgtcctacggaacggggtaaccagtccgtagtacctaacggttgtaaccttagtacaagggtacggtaaacggttacccgaagggaccgtaagggacgggtaacggacggtacgtacgaactttaacgttacgtagtaaccgaaacgtaggtaacgaacgtaggtaacggtaacggttacgttacgttagttaggggtttcggtacgggtacgggaaccgggtaaaccgtacggcccgttacggacccgggttaccgttaagggtacccgaacgtacccggaaagggtcccgtccggtcccccggttacccgg

SEQ ID NO: 201345 - DNA, 978 bp, Homo sapiens
  misc_feature: GYAE6OF01DJG5L.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctctgacgcctctatgacgctagacacacgccctacccgtggtgtacacgtccgtaccccgagggaaccaggaccggccaaagggtacctaccgacccgttgccgttccgtacgacgaaggtacgttacgggaaccgtacggaaacccgtaaaaaaggtaaaactttagttcggttaaccgttttaaaggttttacgggttaaaacccgaaaacggaaaacggaaaaccggaccccggaacggggacccggaaccggggtcccccgtttagggtttacggtttaacgggttaattaaaccggtttaaaattaaaacgttaaaaacggtaaccgtaacgttacgggaacggaacccgggtaccctaacgtaacggtaaccgtaccgttacccgtaaggtacggtacgttacgtttccgtacggtcgtcccgtaccgacggtaccgtaccgggaacgggtaaccgacgtaccgaggttacccgtacggttacgtacgttaacgtaccgtaagggtacggtaaaccggtacgggaggaaccggtaaagggtacgggaacggtacgggtaacgtaccggttaactttaacgttaacgttacgtaaaaccgaaaggtaaacggtaacggaaacggttaaaggtacggttaaaccggttacgttaacggttacgggttttacgggggttaaccgggtccgggggtaacgggaaacccggggtaaccgtaaaccgggttacccgttacccggggtaacccggttaaccgggtaacccggttaacccggaacccggggtacccgtaaccgggtccccgttccccggttaccccggtttaccccggg

SEQ ID NO: 201346 - DNA, 790 bp, Homo sapiens
  misc_feature: GYAE6OF01EFVIM.21.46.E02.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgacggcctctatgagctgacacacgcccaccgtggtntcagtcgtacccgaggacacgaccggcctaggactccacctgccttcgtgccgaagtgtacggaccttacgaaccaaaaagtaaaattagtgtaccgttttaagtacggtaaccaacgaaggaaacgaccgacggccgaacggtccccttggtagtttaacgtagtaattaagtaaacgttaaaacgaacaacgttggaacggtaacggtaccctacgaacgtacgaacgttccccgaggaaacgtcgtaactttccgcttcgggaccttccgaacggtcgacgaacggggaaccaggtccgaaacgtttcgacgtttagtaccgtaagttcgaaggtcgtaaaggtcccgaaagggacgagggaaagggaccgtagggacttagtaccttaagtacctaacgtaacgtaaacgaacgaagtaacgtaagggttaaccgtaggttaacttcggtaaggtttcggggtacggttccggggaaaccggaacggggtaacccgtaaagggaccgttacccgggttacccgggtttaccgtaaccggggttaccccgaaacgggtacccctaaacggggttcccccttaaccccggggccccccgtttaacccggg

SEQ ID NO: 201347 - DNA, 688 bp, Homo sapiens
  misc_feature: GYAE6OF01DM4B3.21.46.E02.1.454.CMB.1.raw
  modified_base (178)..(178): a, c, t, g, unknown or other
  misc_feature (178)..(178): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctctatgagctgacacagccctacccgtggtntcagtcgtccccaggacagacggccaggctccacctgctctagcagntcggactagaccaaaagaatntcgtacttattacggtaacaacgaaggaacgaccgacggccgacggccccttggttagttagataattaagtaagtaaacgacacgtaggacgccggtacctagagacgtactccgagacgcttacgttcctcgtacgcctacgtaacgtccgtacggaacgggtacaggtacctacggtaccgtacgttacacgttacgacgtaggtacgaacgtcgacggacgtaaggacggaggtacgtcgtagtaacttagttcgaacgtaacgaacgagtaacgtaacggtaggtaccgtaaggttactagggttaggttcggggttaccgggtacgggacgggtaacggtaccggtaacgtaccggttacggtacccggtttacggacggttaacccggtaaccggaccccgtagggtccccgtccccggtcccccggttacccgg

SEQ ID NO: 201348 - DNA, 772 bp, Homo sapiens
  misc_feature: GYAE6OF01DC4PX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctctatgagctgacacagccaccctggtgtcagtcgtcccaggacagacggccaggactccactgctctgacagagtggactgaaccaaaagaaatgtcgtacttagttacggtaaccaaacgaagtaacgacccgaacgggaccgaacccgggtacccccgttaggttacggtttaaggttagttaaacgttaaacttaaaaggttaaaacgaaccgtaaccggttaggaacggtaccggggtaccccctaacggtaacggaaacggtacccgttaaccccgttaggaacggtacgttacttttaccgtaccgttcgggcctaccgaagtcccgacgaacggggtacgagtaccgtagttaccgtacggttacgtaacttatacggtaagttacggaacgtaccggtaggaacgtaagggacggtacgacggtacgtaacgacgtttactacgttaacgaacaaacggtacgtaaggtaacgtaggtaaggtacggttacttaaccggtgggttacgggttacgggtccgggaacgggtcggaaaccgtacggccgttacgggtaccgtccggttaacggacccgttaacggacccgtacggtccgtccccggttacccgtaccgg

SEQ ID NO: 201349 - DNA, 774 bp, Homo sapiens
  misc_feature: GYAE6OF01BUHTY.21.46.E02.1.454.CMB.1.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccaggacacgacggccaggactcacctgctctgcagatggactgaccaaagaaatntgacttattcggtaaccaanagaagccaggccagccctgtgtagtgatatataaagacacgtgacgtacggccctanaagacgtactcccgtagacgtcgtaactttcgacgtggacctccgagtccgtaacggaacgggaccaggtcgaacgttaccaacggtttacgtaacttactcgtaagtacgtaaacgttcccgaacgggacgaaagggtaacgggaaccgggtaacggtaccgtaagtaaaccgtttaacgtttaacttaacggtaaaccgtaaaacgtaacggttaaacgaacccgtaaagggtaacggttaacgggtttaactaacggttaacggtttacgggggttacgggtttacccggggaacggggtaaacccggggtaaaccgtaaaccgggttcccggttaaacccgggttaccccgggttaccggttaaacccgggttacccgaacccggggttaacccccgaaaacgggttccccggttaaccccccgggtacccccccgtttaacccgggg

SEQ ID NO: 201350 - DNA, 795 bp, Homo sapiens
  misc_feature: GYAE6OF01B6RTN.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacgaggctcgtgacggccctcctatgagctagacacacgcccacccgtcggtgtcacgtcgtaccccgaggaccgacggaccggccgaggtactccgaccttcgcttcgngacagagtcggacacgaacaaagaattgtagtctttagtacgtaaccaacgaagacgcgacggccgacggtccgtgttagttaggagtaataataaagtaacgactagtacggaacggtcggacccctaggaacggataccgtaccgtacggacgtacggttacctttctacggtcgtacctaccgcgtacgtaccggaagggtacaccggtaacggtacgttacgtaaccggttcttaccgacgttacgtaaggttaccggtaaacggttacccggaagggaaggaaaccggggttaagggaaaccgggtaggtaccggttaaacgttaaacgttttacgtaaacgtttaccggaaaacgtaaaacggtacggttaaaacggaaccgggtaaggttaaccgggtaaacgtttacggttccggttaaagggggttccggggtaagggtttaccggggaccgggtaacgggtaaccgtggtaaccggtcccggtacggtaaccggtccgtacgaccggtaccgtaccggcccggttacccgtcccggtacccg

SEQ ID NO: 201351 - DNA, 727 bp, Homo sapiens
  misc_feature: GYAE6OF01BKH94.21.46.E02.1.454.CMB.1.raw
  modified_base (714)..(714): a, c, t, g, unknown or other
  misc_feature (714)..(714): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctctgcacaggctctgacggcctcctatgagctgacacacgcccacccgtcggtgtcagtcgtccccaggacacggaccggccaggactccacctgctctgacagtacgtcggactagaaccaaaagtaatatagtactttagttacggtaaccaacgtaacgaacgaccgaacggaccgaccggtccccgttaggttagttaacggtagtaataataaacgtaaacgacctaacggtacggaaacggaccggtacccctagaaacggtaacgtaccgttaccccgtaggaaccgtacggttactttaccgttcgtacgtcccgtaccgacggtacgaccggaacgggaactacgacgaacgttccgtacgttacgtactacgtacgaggttacgaacgtacgaacgggacgaacgggacgggacggtacggtcgtaagtaactttacgttaacgtacgttaacgaaacgtacggtaacgaacggtaggttaacggacgtttacgtacgttaagggttgggtaccggtcgggaaccgggtaacgaccgtagctacggtacctagtacggacgacgaccaaggtccnccgtcccgtacgg

SEQ ID NO: 201352 - DNA, 862 bp, Homo sapiens
  misc_feature: GYAE6OF01E23EG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtgtcagtccgtccccgaggacgagaccggccgaggactccacctgcctctgcagtagtcggactacgaaccaaaagaattagtcgtactttattacggtaaccaacgaagaacgaccgacgccgacggtcccctgtagttagtagattaagtaataaaacgctacgtaggacgtacggccctagaaggtacgtaccttacccgaggtacgtaccgtactttacgtcgtaccggccctaccggacgtccggtacggaacggggtacccaggtaccgtacggttaccccgttaaggtttaccgtaacgttaacttacggtaacgggttacgtaaccgggtacccgtaacggggtaaccgaagggggaacgggaaccgggtaggttccggttaacggttaacctttaaaccggtttacgtaaccgttaacgtaaaacgtacggttaaacggaccggtaaagggttaacgggttaaacgtttaacccgtacgttttacgggggtttacggggttccgggttaccggggtaaaccggggtaaacgggtaaccccgaaaggggttcccccgttaaccgggttaaccccgggttaccggtaaaccgggttaccccgggtaaccccggggtaaacccccggttaacggggtcccccctttaccccccgggtacccccccgggtttacccgg

SEQ ID NO: 201353 - DNA, 543 bp, Homo sapiens
  misc_feature: GYAE6OF01ER5TB.21.46.E02.1.454.CMB.1.raw
  modified_base (322)..(322): a, c, t, g, unknown or other
  misc_feature (322)..(322): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
tcagtcgtcgctcgcacgaccggtgctcgattttagactcatctacagggaaagggggtgggtccaggaggcagaactctgggtgtctcaccatggcctggatccctctacttctccccctcctcactctctgcaacaggactctgaggcctcctatgagctgacacagccaccctcggtgtcagtcgtccccaggacagacggccaggatcaccgtgctctgcagatggactgaccaaaagaaatatgcttattggtaaccaacagaagccaggccaggcccctgtgttagtgatataataaagacactgagacggccctnagagactcccgtgacgcgtacttctacgtggcctccgagcctacgagggacagcagtcacgttgactatcagtgaacgtccaggcagaggacgagtcngactatactgtacaanagtagactagtagagtactcgtagttgggtgttcgggacgggacggaacgagtctacggtacccgtacgtaggtccgacgacccgaaggcctccggcccccgtacgg

SEQ ID NO: 201354 - DNA, 654 bp, Homo sapiens
  misc_feature: GYAE6OF01A64OH.21.46.E02.1.454.CMB.1.raw
  modified_base (530)..(530): a, c, t, g, unknown or other
  misc_feature (530)..(530): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgacttagttacggtaccaaacgagaacgtccgaaggaccgaacggcccctaggttcgttaagtgtaattaagtaataaagacctacgttgaacggaacggcccctagagaagtactccctagacgcgtacttcgtcgtaggccctacgtacgtctacggacgggaacctaggcctaacgttacctaacggtttgaacctttataccggtaagtacggtaaagtcccgaagggttccgaaggtaacgggacgaggccttaggaacttacgttacgtagtaaccaaagngttaacgacgttagtacgtaacggtactgaggtttcggagggttacgcgggtaaaggcccgtaagtccggtacggaccgtcgtaaggtccaacggacccgtaggccttacccgcccgttaacgg

SEQ ID NO: 201355 - DNA, 575 bp, Homo sapiens
  misc_feature: GYAE6OF01A4WOV.21.46.E02.1.454.CMB.1.raw
  modified_base (257)..(257): a, c, t, g, unknown or other
  misc_feature (257)..(257): n is a, c, g, or t
  modified_base (317)..(317): a, c, t, g, unknown or other
  misc_feature (317)..(317): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaagaatatgcttattggtaaccaanagaacgcaggccacggcccctgtgttagtgatataataaagacacgtgagacggccctanaaggagactccctagagcgtattcgtctcggcctccacgtctacggagggacacgcaacgtcgacgttcgactagtctagtagacgtaccgaggcgaaggaggacgnggactagtactagttactacgtaacaaacgtagtaacgataaggtaggtacgttactacgtaggttcgggtaggttccgggagggtacgggaacgacgtctacggacccgttcgtaggcaacgcccgaaggcgtcccggtcccccgtacgg

SEQ ID NO: 201356 - DNA, 787 bp, Homo sapiens
  misc_feature: GYAE6OF01DX3TT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgtcttattacggtaaccaacagaacgccacggccacggcccctgtcgttagtgaataataataaagacacgtaggagacggccctagaagagactcccgtagagcgtattccgtcgtggcctcgacgcgtacgaacggggacacggacgtaacgtcctaacggtttacgaaccttaagttacgaacggttaaggtaaaccggttaccccgaaaggggtaacccggaagggaacggggaacgggtaacgggtaccgttaacgggttaaacctttaacggttttaaaccgttacggttaaaccgtaaaaacgtaacgggttaaacggaaacggttaaacgggtaagggttaaaccgggtttaccttaacgggttaggttttcgggggttacgggtttaccggggggaaccggggtaaacgggtaacccggtaaacgggttaccggttaccgggtaaccccccggttaccggttaacgggtacccggtaacgggtacccccgggtaaacgggtcccggtaccccgggtccccccggttacccgggg

SEQ ID NO: 201357 - DNA, 700 bp, Homo sapiens
  misc_feature: GYAE6OF01C2HHL.21.46.E02.1.454.CMB.1.raw
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (326)..(326): a, c, t, g, unknown or other
  misc_feature (326)..(326): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacacgcccacccgtcggtgtcagtcgtccccaggacacggaccggccaaggactccaacctgctctgacagaagtcggacagaaccaaaagtaatntgacttagttacggaaccaanagaacgccaggaccacggccctggttagtagtacgtaataactaaanaacgtactaacgtaggacggtacggaccctagaacggaacgacctacccgtagacggtaacgttcttctccgtacggtcctaccgacgttaccgacggaacgggtacacgtacgtacgtaccgtacggttacgtactaacgtcgaacgttaggactacgaggacgaaggtacggaacgacgtacgtagtaacttacgttaactacgtaacctaaacgtaggtaataacggaagttacggtaaacgttccgtaagttgggttacgggttacgggttaccgggaaccgggaggtaaccgacggtaccgtacccgggttaccgtacccgggttaacgccgttaaccgaccggaccgtccgtcccgtccccgttacgg

SEQ ID NO: 201358 - DNA, 867 bp, Homo sapiens
  misc_feature: GYAE6OF01AV2OZ.21.46.E02.1.454.CMB.1.raw
tcagtcgtcgctcgcacgaccggtgctcgatttagactcatctacagggaaagggggtggggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatccacctgctctgcagatggactcgaccaaagaaatatgtacttagttcggtaaccaaacaggaacgccaggacccacggccccttggttacgttaagtcgtaattaataataaaacgactacgtaggacggacggtccctacgaagagtaccgtacccgtagacggccgttaactttccgtacgtcgggtaccttacccgacgtcgttaccggaacggggtaacctacgggaccttaacgggttaccgttaaccgggttacgtaacccgttaacgtaccgttaaacggggtttaacggaaaccggttaccccggaaacggggaacgtaacggggaaacggaaccgggtaacgggttacgtaacggttaaccgttttaacgttaaccggttaacgggtaacctaaaacgggttaaacggttaacggtaaaccgttaacggggtaaacggttaccgggtttaacttaaccgggtttaacgggtttacgggggtttacggttaaccgggggaacccggggttaaacgggggaaccccggtaaaccgggtttcggtaccccgggttaaacccgggtttaccgggttaaacccgttccgggaaacccggtacccccggtaagggtaccccggttcccccggttaacccccgggttaccccggg

SEQ ID NO: 201359 - DNA, 715 bp, Homo sapiens
  misc_feature: GYAE6OF01B6V9H.21.46.E02.1.454.CMB.1.raw
  modified_base (176)..(176): a, c, t, g, unknown or other
  misc_feature (176)..(176): n is a, c, g, or t
  modified_base (240)..(240): a, c, t, g, unknown or other
  misc_feature (240)..(240): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctgacacagcccaccctggtntcagtcgtccccaggacagacggccaggatcacctgctctgcagatggactgaccaaagaaatntgtacttagttggtaaccaaacgagtaacgccgaggtacccgacggtacccccttgtagttaacggtgtaagtaagttaagtaaacgaccaacgttaggacggaccggaccccttacgaagagtacctcccgtaggacgaccgtattccgtcgtacggtcccttacgacggtcctacggaacgggtacacggcgtacgtaccgtaacggtttcgaacttactacgaacggttcgtaaacggtccgaaggaccgaaggtaacggacggtacggtacgtacgtaactttaacgttaccgtacgtaaccgaaacgttacggtaaacgaaccgtaagggttaacgtaaccgggtttactacggtaagtttcggggtacgtttacggggacggtaacgggaaccgtagccggttaccggacccgttaccgtaacgggccgtaacgacccgtaaggtcccgtacccgtcccccggtaccgg

SEQ ID NO: 201360 - DNA, 832 bp, Homo sapiens
  misc_feature: GYAE6OF01CUQSC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacacgccacccgtggtgtccagtcgtccccgaaggacacggaccggcccaagggtactccgacctggcctcgtgaccgaagagttacggactacggaaccaaaaaggaaacttagtacgtacgtttaacgttacgggtaaacccaacgaacggaaacgcccgaacggacccgaaccgggtccccttggtaggtttaacgtaggtaaattaaccttaaagtaaacggaactaccgtaggaacgtaaccggcccttaagaacgacgtaccgtaccccgtaggaacggttacgtactttaccgtcgtcggcttaccggaacgccgttacggaacgggactacgaccgtaagtacctaacggttacacgttaagtacgtacgtacggtaaacggttcgaacgggtaagaacgggaacggaacgggtacgggtacgttaacggtaaccgtttaacgtttaaccgtaacggtaaaccgtaaaacgtaacggtaacggtaacggttaacggtaacggttaaacggtaccgttaacgtacgggttacggggttacggttaccgggaaaccgggtaacgggtaaaccggtaaccggttcggtaaccgtaccgggtaccgttaccgggaaccttacggaacccggtacggtcccggtacccggtcccccgttaaccggg

SEQ ID NO: 201361 - DNA, 731 bp, Homo sapiens
  misc_feature: GYAE6OF01CPD7X.21.46.E02.1.454.CMB.1.raw
  modified_base (238)..(238): a, c, t, g, unknown or other
  misc_feature (238)..(238): n is a, c, g, or t
  modified_base (388)..(388): a, c, t, g, unknown or other
  misc_feature (388)..(388): n is a, c, g, or t
  modified_base (452)..(452): a, c, t, g, unknown or other
  misc_feature (452)..(452): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacgaggctctgacggcctctatgagtctgacacacgcccacccgttcggtgtctaggtccgtccccgagggacaaggaccggaccaggtactccaccgtgcttcgngacagtacgtcggactcgaactaaaagtaaattgtagttactttaagtaccggtaacctaaacgaagaaacgccgaacggacccgaaccggtccccgttagttgttaacgtagtaacttaagtaaataaacgaccaagtagaacggtacnccctaagagtacacctccgtaggcgtcgtattcctcggtcgcgtcctaggcctacggaggtcanacgtatacgtacgttctacgtagtcgtaggtacgtaacgtcgaggacgaggtacggaacgtaggtactacgtaactttacgttacgtaacgtaacgtaaacgtaagttaacgtaagtaaacgggtacgttaacggttaaccgttacggttagggttacgggttacggtacggggtaaaccggaacggtaacggttacgggacgttacgggtaccccgtacggtacccggacgtacccggtaacgtaaccccggtccggtcccggttaacccccggtacg

SEQ ID NO: 201362 - DNA, 759 bp, Homo sapiens
  misc_feature: GYAE6OF01C5332.21.46.E02.1.454.CMB.1.raw
  modified_base (273)..(273): a, c, t, g, unknown or other
  misc_feature (273)..(273): n is a, c, g, or t
  modified_base (304)..(304): a, c, t, g, unknown or other
  misc_feature (304)..(304): n is a, c, g, or t
  modified_base (748)..(748): a, c, t, g, unknown or other
  misc_feature (748)..(748): n is a, c, g, or t
tcagtcgtcgctcgcacgaccggtgctcgatttagactcatctacagggaaaggggggtgggtccaggaggacagaactctgggtgtctcacatggcctggatccctctacttcctccccctcctcactctctgcacaggctctgacggtcctctatgagctgacacacgccacccgtggtgtcacgtcgtacccgaggactaggaccggccaggactcctaccgtgacctctgaccaagtcgtacggacctggaacctaaaaggtaaacttntcgttattaacgttcgaaccaacgagaaccnccgacggaccctaccggtccctaggtcgttagtactataactaacgaacgactacgtacggacggaccgtccgtacgacggactacccttccgtaagaccgtacgttactttaccggtcggtacgtaccgttcccgtaggtacccggtacgacgggacctacggtccgttacgttaacccgggttacgtttaccggtaacctttaacggtaacgtaacgggtttaccggaaaccggttacccggtaaacggccgggtaaaacggggcccggggtaacggaccggtaccggtaacgttaacgttaaccgttttacgacgtaacgtaacggtagtaaccgtagtaacggttaggtacgttactgggttgttacggttcgggtaccgggagggtacacgttacggcggtttacgacccggtgtaacgcgtaacgcccgtaggtcccncgtccctacgg

SEQ ID NO: 201363 - DNA, 720 bp, Homo sapiens
  misc_feature: GYAE6OF01BK8V6.21.46.E02.1.454.CMB.1.raw
  modified_base (313)..(313): a, c, t, g, unknown or other
  misc_feature (313)..(313): n is a, c, g, or t
  modified_base (536)..(536): a, c, t, g, unknown or other
  misc_feature (536)..(536): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggaggcctcctatgagctgacacacgcccaccctggtgtcagtcgtccccgaggacaggaccggccaggactcacctgctctgcagatcgactcgacaaagtaatgtgtacttagttacgtaaccaacgaggaacgccgacgggacccacggtccccttggttagttacgngtaaacttaagtaataaacgacctacgtagacgggtaccggccccgttaggatacccgtccgtagggacgtccgtgtttaccgtcgtcggaccctcgacgtccgtacggtacggactaggaccgtacggtactacggttacgaacgttacgtacggtacgtacggacgttaccggacggacgaagggaacggtacggacggtcgtacgtaacttacggtttanacgttaacaaacggtagtaacgaacgtaggtaacgtacggttaactacggttaggttacggggtacggttaccggggacgggtaaccggaccgtagggtccccgttaaggacccggttccggtaacggtacccgacccggtaccgggtaccgcccggttaccccgtccccggttccgtaacccg

SEQ ID NO: 201364 - DNA, 568 bp, Homo sapiens
  misc_feature: GYAE6OF01EL6FN.21.46.E02.1.454.CMB.1.raw
  modified_base (362)..(362): a, c, t, g, unknown or other
  misc_feature (362)..(362): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgtcttattggtaaccaacagaacgccaggccacggcccctgtgttagtgatatataagacagtgagcggccctagagagactccgtgagcgattcgtcgtgcctcagcctcgagggacngactagtcacgttnactatcaggtnaagtcgaggnaggaggacgnggctagacttatactgtacaaagtagtaacgaagtaggtaagtagtactacgtaggttgggttcggtcgggcgggaacgggtaaccgaggtccgtacggtacccgttacggtacgggtaccacggacccgaacgggtcccgtcccggtcccccggttccgg

SEQ ID NO: 201365 - DNA, 684 bp, Homo sapiens
  misc_feature: GYAE6OF01AFOL5.21.46.E02.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacgcctcctatgagctgacacacgcccaccgtcggtgtcagtcgtcccaggacagacggccaggatccactgctctgcagtntacggactacgaccaaaagtaatatgtacttagttacgtaacaactagaacgccgtacggaccgacgtcccctgtaggtagtacgtaataagtaaactaaacgactacgtagtacgaccgctacgagtacgtactccgtgagacgtacttccacgtcgcctcgacgccgtacgaggacacgcgtacgtacgtacgtacgtacgtatacgtagtagtaacgtaccgaggacgaacgggacgacggacggtacgtacgtaactttagtaaccgtagtaaaccaacggtagtaacgacgtaaggtaaggtaacgttacgtacgttacgggttgggtacgggtaccgggtaccgggaaacgaccggtaaacgggttccgtacgggtaaccccgtacggttaacccggtacgggtaacccgtacccggtaaccggtcccgtccccggtccccggttaacccgg

SEQ ID NO: 201366 - DNA, 714 bp, Homo sapiens
  misc_feature: GYAE6OF01CLDI2.21.46.E02.1.454.CMB.1.raw
  modified_base (182)..(182): a, c, t, g, unknown or other
  misc_feature (182)..(182): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctagacacacgcccacccgtcggtntcagtcgtccccgaggacagacggccaggactaccacctgctcgtgcagatcggactcgaaccaaaaggaatatcggtactttaagttacggtaaccaagacgaaacgacccgaacgggacccgaccggtccccctaggttcggttaggtaggtaataagttaagtaaaacgaccaccgtaggaacggacggtccctacgaacgacgtacctacccgtagacggtacgtacttaccgtcgtcggtccctacgcgtaccgtacgaacgggaccgacgtacggtacgtacgtacgtttacgaacgttacgtcgaaaggttcgaacggtaccgaaggtacggaaggacgggaacgtacggtcgtaagtaccttattaacgtacgtaactaacggtaagtaacggaggtaacggtacggtaacgttaccgtagtagggttcgggtacggtacgggacgggtacgaacggtacgtacggtaccggtacgtacggttacgccggtaacgcccgacggtccggtcccgtcccgtaccgg

SEQ ID NO: 201367 - DNA, 595 bp, Homo sapiens
  misc_feature: GYAE6OF01DYS0T.21.46.E02.1.454.CMB.1.raw
  modified_base (240)..(240): a, c, t, g, unknown or other
  misc_feature (240)..(240): n is a, c, g, or t
  modified_base (286)..(286): a, c, t, g, unknown or other
  misc_feature (286)..(286): n is a, c, g, or t
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctctgcagatggactgaccaaaagaatntgcttattggtaaccaacagaagccaggccacggccctgtgttagngatatataaagacacgtgagacggtccctanagagtactcccgtagacgacgtacttcctcgtaggtccttaccgagtcctcgaagggacacgctagtcacgttgactactcgtagtagacgtccgaggcgaaggacggacgaggctagacgttattacgtcgtacaacgagtaacgacgtaagtaggtacgtacgtacgtaggttgggtcgtcgggacgggtagggaccgtaacggcgttacggtacccggttaccgtagggtaccctaacggaccccgaaggtcccgtacccggcccccgttacggg

SEQ ID NO: 201368 - DNA, 558 bp, Homo sapiens
  misc_feature: GYAE6OF01AG923.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtacttattaggtaccaacagaagccaggccaggcccctgtgttagtgattatataagacacgtgagacggccctgagagactcccgtgacgcgtatttcctcgtcggcctccgagcctacgacgggacacgacgtagtctacgttacgactatcgagtacgtaacgtccgaggcaggaggacgaggctgtactatactgaccgaatagaagacaggtagtaggtactagtagttgggtgttcgggaggacgggaccgagtctcggtaccctaccgtaggaccacggcccgaagcctcccggtccccgttccggg

SEQ ID NO: 201369 - DNA, 889 bp, Homo sapiens
  misc_feature: GYAE6OF01CKPTA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggtcctcctatgagctgacacagcccaccctcggtgtcagtcgtccccaggacagacggccaggactccacctgctctgcagatggactcgaccaaaagaaactgttacgtactttagttacggtaaccaacgaaggaaccgccgtaccgggacccgtaacccgggtcccccttagggttacgtttaacggtgtaaaagtttaacgtttaaaacgtaaaaaccggtaaccgttaccggtaagggtaacccgggtaaccgggtacccccttaaggaaccggaacgtaacccttcccggtaggaacgtccgttaactttccgtcgttcggccccttaccgaagtccgtaaccggaacgggtaccacggtaccgtagtacccgttaacgttacgtaacgtacgtaccggttaaggttacggaaacccggttccggaaaggtaccgggaaacgggtaacgggtaccggtagggttaacccgttaacggtaacccgttttaaccgttttaaaccgtacggttaaaaccgaaacggttacggttaacgaacccggttaaagggtttaccgggtaacggttaaccgttcgggttaagggttttcggggttaccggggtcggggaaacccggggtaaccggaacggtaccggttaccgggaacccggtttccccgggttaaccgtaacccggttcggaacccggttaccccggtacggtcccccggttcccccggtaaccccggtttccccgg

SEQ ID NO: 201370 - DNA, 923 bp, Homo sapiens
  misc_feature: GYAE6OF01D3Y47.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacacgcccacccgttcggtgtcagtcgtccccaggacaggaccggccaggactcacctgctctgcagatggactgaaccaaaagtaaatcgtgtactttagttacggtaaccaaacgtaagaacgcccgaaggcccgaacgggtcccccttggttacgttaacggtagtaatttaagtaaagttaaaacggaacctaacgttagggaaacggaccggtaccccgtaagaacggaacgtaccgttaccccgtaggaacgtaccgtaacttttccgtacgttcggcccttaccgaacgtcccggttacggaacgggtaccaacggtacgtaacgttaccgtacggtttaacgtaaccgttacgtacgtaacggttaacggtaacgttacccggaacgggtacgtaagggaaccggggtaaccgggaggttaccgtaacggtttaaccgtttaaccgtttaaccgttaacggttaaaccgaaaaccggtaaggttaaaccggtaaccggtaaacgggttaaacgggttaaacgggtttaacccgttaaccgggtttaaggggtttacggggttaccggggttacccgggggtaccgggggaaaacgggttaaaccccgggtaaacgggttacccggttaacccggggttaacccccggttaacccgggttaaaccgggtaaccccgggtaacccgggttaaccccccgggtaaaccgggggttccccccgtttacccccggggtccccccggtttaacccccgggg

SEQ ID NO: 201371 - DNA, 729 bp, Homo sapiens
  misc_feature: GYAE6OF01BUKRD.21.46.E02.1.454.CMB.1.raw
  modified_base (254)..(254): a, c, t, g, unknown or other
  misc_feature (254)..(254): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacacgcccacccgtcggtagtcagtcgtccccagggacaggacggccaggactccacctgctcgtgacagatggactgaacaaaagtaatngtacttatacggtaacaacaagaacgccgaaggccaacggtcccctggttacgttagtagaacttaagtaacgtaaaacgactacgtaggaacggtacggaccccttagaaaggtacgtaaccgttccgagggtacgtaccggtaactttccgttacgtcgggtaccttaccacgtaccgtacggaagggaccgaggtacgtaacgttacgaaccggtttagaaccttaacgttcgaacggttagaaacggttccgaagggctaaacggggaggacggacggtcttaagacttaacgtttaacacggttaacaaagtaacggtaagtaaccgaaggttaacgggacgttaacgcggttaaggttcggggttacgtaccggggaacggtaacggggtaaccagtaccggtacggtacccgttcgtaaacgggcgtaaccggtaccgaaccgggtcctcccggtccccggttaccgg

SEQ ID NO: 201372 - DNA, 825 bp, Homo sapiens
  misc_feature: GYAE6OF01EI5V0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccgaggacagacggccaggatccacctgctctgcagagtggactgaccaaaagaatatgtacttagttacggtaaccaaacgaagaacgacccgacggacccgacgggtccccctaggttcgttagttacgtaagttaattaacgtaaaacgaaccacgttaggaacggtacggtaccctacgagagtacctcccgtaggtacgacgtaacttccgtcgtacgtcccttaccgaacggtccgtacggaacgggaccgaacgtaccgtacggttaccgtaaccggtttacgtaaccgtttactaccggtaagggttacgtaaaccggttaccgaacgggtaacggaagggaaccgggaacggaacgggtacttacggtaactttaacgttacgttaacgtaaccgtaaaacgtaaggtaacgtaacgtaacggtttaacgggttaaccgggttaacttacggttaaggggttacggggttacgggttaaccgggggacgggtaaaccggggtaaccgtaaaccgggtacggttacccggtaacccggttacccgggtaacggtaaccccggtaaccgggtaacccccggaaccggggttcccccgttacccccgggttcccccccggttaacccggg

SEQ ID NO: 201373 - DNA, 682 bp, Homo sapiens
  misc_feature: GYAE6OF01D4Z60.21.46.E02.1.454.CMB.1.raw
  modified_base (550)..(550): a, c, t, g, unknown or other
  misc_feature (550)..(550): n is a, c, g, or t
  modified_base (640)..(640): a, c, t, g, unknown or other
  misc_feature (640)..(640): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacacgcccacccgtcggtgtcagtcgtcccaggacacgcggccaggactccacctgctctgcagagtggactacgaccaaaagaatagtcgtactttagtacggtaaccaagacgaacgaccgacggacccgacggtcccccttaggttacggttaaggtacgtaagttaagttaaacgtaaaacgtaccgtaacgtaggtaacgggaccgtccctagacgaacgtacctccgtaggacgacgttacttcctcgtcggtacctccgacgtccggtacggaacggcacgtactacggtaccttaggtactacttagtacgtacgtaacggtacggtccgaggaacgacggaaggacggtcggtacgtagtacttaacgttccggtaanaacccgtaaagtacggtaagaacgtaggtaaaggcgttaactacggttaggtttcggacgggtcggacgggaacgtacgacgtcggtacnccggttcgacgtacgacgaccgacgtcccgtccgtccgtacg

SEQ ID NO: 201374 - DNA, 762 bp, Homo sapiens
  misc_feature: GYAE6OF01ARTWC.21.46.E02.1.454.CMB.1.raw
  modified_base (341)..(341): a, c, t, g, unknown or other
  misc_feature (341)..(341): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagaccggccaggactcacctgctctgcagatggactgaccaaagtaatagtgtacttagttggtaaccaacaggaacgccgaggccacgggtcccctggtgttagtgaataagtaataaacgactacgtggaaggcggaccctanaacgaactaacgtccctacggacgacgttactttccacgtcggacctccgacgtccgtacggaacgggaaccgacgcgtacggttcctaacgggtttacgaaccttagtaaccgtaacggttacggtaaccggttaccgaaacgggaccggtaaaggaacggggaacggtaaccggggacttaagtaaccgtttaaccgtttaacttacggaaacgaaacgttacgggtaaacgtaacgggtaaggttaaacggtacgttaccgttacggttacggggtttacgggtacggggtttacggggacgggtaaacggggtaaccctagggggtaaccgtcggttaaccccgggtttaacgtacgggtacccgtaaccggtacccccggaagggtccccgtacccccggtccccggtttacccgg

SEQ ID NO: 201375 - DNA, 636 bp, Homo sapiens
  misc_feature: GYAE6OF01AWWI2.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccgccaggatccacctgctctgcagatggactgaccaaagaaatatgtactttattacggtaccaaacgtagaacgccgaggccacggtcccctgtcgttagtagataataataaagacactggagacggaccctcagacgactccgtagacgcgtactttctaccgtcgggacctcgaacgtccgtacgaacgggtacagccgtacgtacgtacgttacgaaccttagtaccgaggttacggaacgtccgtaacggcgaagggtagaaccgggagtaccgtgtaaccttaacgttacgttacgaactaaacgtagtaaccgaacgtaggtacggtaacgtaactacgtaggtttcgggtacgggtcggtacgggaacggtaacgagtccgacgtaccgtacgtacggcacgacccgaagtccgtcgccccgtacg

SEQ ID NO: 201376 - DNA, 561 bp, Homo sapiens
  misc_feature: GYAE6OF01D2UOV.21.46.E02.1.454.CMB.1.raw
  modified_base (321)..(321): a, c, t, g, unknown or other
  misc_feature (321)..(321): n is a, c, g, or t
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacggccaggatcacctgctctgcagatggactgaccaaaagaaatatgtcttattggtaaccaacaagaagccaggccacggcccctgtgttagtgataatataaagacactgagaggccctanagagactcctgagcgattctcgtggcctcgagctacgagggacagcgagtcacgttnactatcgagtagaacgtcgaggcgaaggacggacgacggtntacgactttattactgtaacaaacgtagtaanaacgaagtagtaaggttactcgtaggttgggttggtcgggacggagggaccgaaagccgtacggtccgtacgtacggcgacggacccgaggtccgtccgccccgtaccgg

SEQ ID NO: 201377 - DNA, 724 bp, Homo sapiens
  misc_feature: GYAE6OF01AXFGW.21.46.E02.1.454.CMB.1.raw
  modified_base (402)..(402): a, c, t, g, unknown or other
  misc_feature (402)..(402): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagatggactgaccaaagaaactatgacttagttcggtaaccaacgagaacgccgacggccacggcccctggttgttacgtgaatataagtaaaacgactaacgtggaacggaccggtacccctagaaggaacgtaccttccccgtaggacgacgtaactttccgtcgtacggcctaccgngtccgtacggaacgggtacgacgaccgtacgtaccgtacggtttacggaacttagtaccgtagggttagtaaaccggttcccgaagggtacaaaggggaacgggaacggtagggtaccttaaggtaacctttagttaaccgtacgtaaccgtaaacgtaagttaacggaaccgtaagggttaacggtaacggttacgttacgttacgggtttcggggttacgggttacgggacggggtaaccggtaccgacggtacggtacggtcccgtacggttacggtacgaccgggtacccgaacggtccgtcccgtcccggttaccgg

SEQ ID NO: 201378 - DNA, 787 bp, Homo sapiens
  misc_feature: GYAE6OF01BKFM4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggaccagaccggccaggatccacctgctcgtgcagagtggactgaaccaaaagaaatagtcgtactttaagttacggtaaccaaacgaagaacgccgaacgggacccgaccggtcccccgttaggttaggtttaacggtagtaatttaagttaaacgttaaaacggaacctaacggttagggaacggtaccgggtcccccttaacgaaggtaacgtaaccttacccccgtaggaaccggtaccggttaactttccgttaccggtaccgggtcccttacccgaacggtaccgtaccgggaacggggtaccacggaccgtaaccggttccgttaaccggtttacggtaaccgttacgtacgtacgggttaacggtaaccggttaccggaacggacgtaaggggaacggtaacgggacggtacctacgtaccgttaattcgttacgtaaacgaaacgtacgtaaagacgtaaggtaaggtacgttaactgttacggttaggggttcgtacggggtaccggaaggtaccgtacgtcgtaccggtaccggtacgtacggtaccgaccgaccggacggcccgtccccggtcccgttcccgg

SEQ ID NO: 201379 - DNA, 686 bp, Homo sapiens
  misc_feature: GYAE6OF01CDK02.21.46.E02.1.454.CMB.1.raw
  modified_base (244)..(244): a, c, t, g, unknown or other
  misc_feature (244)..(244): n is a, c, g, or t
  modified_base (348)..(348): a, c, t, g, unknown or other
  misc_feature (348)..(348): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatccacctgctctgcagatgactagaccaaaagaatntagtcttatacggtaacaacgaagaacgccgaaggccgacggcccctgttcgttagtgaatataactaaagacacgtgaagacgcctacgagagtactacccgngtacgtcgtattccgtcgttggcctccgaagccgtacggacggacaggactacggtacctacggttacgaacttactacgtaggttacgaacgtccgtaagggacgaagggtacggacggaggtacgtaacgtacttaacgttaccgtagtaaaccaacgttaagaacgtacgtaacggtacggtaacgttaccgttaggtacgggtttacggggtacggttaccggggacggaccgggtaaccgaacggttcccggttaaccggttaccgtaaccggttacggaacccggttaccgaacccgggaccgttccccgtcccccggttcccgtacccggg

SEQ ID NO: 201380 - DNA, 785 bp, Homo sapiens
  misc_feature: GYAE6OF01C6UG9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacagccaccctcggtgtcagtcgtccccaggacagacggcaggatcacctgctctgcagatggactgaccaaaagaatatgtactttaattcggtaaccaacgaaggaaacgcccgaagggccctaacgggcccccttaggttacgttaaggtaggaattaaataaacgttaaaaaggacctaacgtaggaacggaaccggcccccttagaaggaacgtaccttaccccgtaggaacgtcgtaacttccgtcgtcggccttaccgaagtccgttacgaacggggaaccaggaccgaaggtttaccaaccggtttagaaccttactacggtaacggttacggtaaacggtacccgaagggaaccgaagggaacgggtaaccgacgggtcttaacggtaaaccttaacgttaacgttaggtaaccgaaaaaccgttggaaaccgtaacgtaaacgggttaacggaacggtttaaccgtagttaacgggttttcggggtacgggttaccggggtaacggggaaaccgggtaaccgtaacgggtcgtaaccgggtaccccggttaccgtaaacgggttccgaaacccgggaccgtaaccgggtcctccccggcccccgttaccggg

SEQ ID NO: 201381 - DNA, 867 bp, Homo sapiens
  misc_feature: GYAE6OF01D3AEP.21.46.E02.1.454.CMB.1.raw
  modified_base (255)..(255): a, c, t, g, unknown or other
  misc_feature (255)..(255): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacacggaccggccaggactccaccgtgctctgcagagtggacctagaaccaaaagtaaattntagtactttaagttacggtaaaccaacgaagaacgccgacggccacggccccttggtgttacgtgaataataagtaaaagactacgtaggaacggaccgggccccttagaacggaacgtaccttaccccgtaggaacggtaccggttactttacccgttcggtcgggtcccgttacccgtaaccggtaccgtacgggtaacggggaaccgacgggtacctaacggtttcccgttaacggtttacggtaaaccgttaacgttaaccggtaacggtacgggtaaaccggttaacccggaagggtaacggaacggggtaacggggaacggtacgggtacgtacgttaacgtttaacgttttaccgttaacggtaaccgtaaacgtaagggtaaacgtaacggtaacgggttaaacgggtaacggttaccgtttacggttagggtttacgggggtttacgggttaccgggggaacggggtaaccggggtaaacccggacggttacccggtacccgggtaaccccggttaccggttaaccgggtaaccggtaaccccgggaaccccgggtaaccgggtacccccggttcccccgggtccccccggtttaaccccggg

SEQ ID NO: 201382 - DNA, 684 bp, Homo sapiens
  misc_feature: GYAE6OF01AC2O8.21.46.E02.1.454.CMB.1.raw
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
  modified_base (295)..(295): a, c, t, g, unknown or other
  misc_feature (295)..(295): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtaccccaggacagacggccaggtatccacctgctcngcagatggactgacaaagaaatntgtcttattaggaaccaacgagaacgccgaggccgacggcccctgtcgtagtnattataataacgacacgtgaagtacgccctacgagacgtacgtcccgttgaaggcgtacgttccgtcgtcggactcccgaacggccggtacggggactacggcctaacggtccgtaacggtcgtaactactacgaggttacgaacgtcgaaggaccgtaagggacggtaacgggacggtatacgtaacttacgttaacttagtaaccgaaagtaacgttaacggaagtaacgggttaagtaaacgggttaccttaacggtacggtttaggggtacggttaccggggacggtacgggaaaccgacggtccggtacggtaccggttccgtaccgggtacctaaccggtaccccggaagtcccggtccgtaaccccccggtggttacccccg

SEQ ID NO: 201383 - DNA, 884 bp, Homo sapiens
  misc_feature: GYAE6OF01A7B2A.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacacgcccacccgtggtgtcacggtccgtccccgaaggaccaggaccggccaaggactaccacccgtggccttcgtggaccagtacgtcgggtacctacggaaccgtaaaaaggtaaacttacgttagttaccgttttaagtttaccgggttaaacccaaaacgaacggaaaccggcccgaacggacccgaccgggttaccccttaggttacggttaagtacgtaagttaaagttaaacgtaaaacgaccgtaacgtaacggacggaccggtaccctagtaacggacggtaccttaccggtaggacgtccgtaactttccggtactcggaccctacgacggtcctacggaacgggtacctaggaaccgtacggtacgttaacggttacctacgttaacgtacggtaacgtacgtaacgggtaccgtagggacggaaacgggtacgggtaacgcggttaacgtaaccgttaacgttacgtttaacgtaccgttaaacgtaacgtaacggtaaacgtaacggttaacggtaaaggttaacggttaccgttagggtttaacgggtttaggggttacccgggtaacggggtacgggtaaacccgggtaaccggaacggttacccgggttaccgggtaaacctttccgggttaaaccggacccggtaaaccccgggtacccggttaaacccgggtccccgttaaccccgggtccccccgggtttaccgg

SEQ ID NO: 201384 - DNA, 756 bp, Homo sapiens
  misc_feature: GYAE6OF01B1YVE.21.46.E02.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtggtntcagtcgtcccaggacagaccggcaggatcacctgctcgtgcagtatggactgaacctaaaaagaaatgtagtactttaagttacggtaaacccaaacgaacggaacgacccgaacgggcccgtaacgggtccccccttaggtttaggttttaaggtacggtaattaaattaaaagttaaaaacggaacctaaccggtaggaaacggtacgggtaccccttaacgaaaggtaaaccggtaaccttacccccgggtaagtaaccggtaccggttaacgttttaccctcggttaaccgggtccttaaccccggtacgtaccgttaaccggaacggggaacctacggtaccgtaacggttaccttaacggttaccgtaacgttactaccggtaaggttaacgtaacggtaccgaaggaccgaaggaggacgaggtcttacgaacttattacgtataacaaagtagacgaacgtaggtagtacggtacttacggtgttgggtagtacgggcggtaacgacgtagtcgacgtaccggtacgtagccggactacccgaacggtccgtcccggcccgttaccgg

SEQ ID NO: 201385 - DNA, 740 bp, Homo sapiens
  misc_feature: GYAE6OF01D2GNX.21.46.E02.1.454.CMB.1.raw
  modified_base (563)..(563): a, c, t, g, unknown or other
  misc_feature (563)..(563): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctcactctctgcacgaggtctcgtggacgtcccttacctatgacgctacgacacgacgccctacccgtcggtcgtcgacgtccgtacccgaggaccgacggaccggaccgaaggacttccgaccgtcggtcctcgtacgacgaggtacggtcggaactacgaaacgtaaaagtaacttgtacgttactttacgtaacggtaaccaagacggaacgccgacgggccgaccggtccttaggtacgttagtacgtaatttaacgtaaataaacggacctaggtacggaaccggtaccgtaccctaagacggtaacgcccttacggacgacggtaccttacgttccgacgtcggtcctaccgacgtcgaacggacggtacaccgtacgtacgtacgtacgttactacgtacgtgacgttacgacgtccgagacggagacggagngtactactacgtatacgaacgactaaggacgtaagtagaaggtacggtacgtacgttacggttagggttccgggtacgggttacgggacggtaaccggtacggtaccgtacggtacggtacccggttacgaccggtacgacccggtacgaccggttccccgaccgtccccggttacg

SEQ ID NO: 201386 - DNA, 687 bp, Homo sapiens
  misc_feature: GYAE6OF01E5FYO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacacgacggccaggatccacctgctctgcagatggactgaccaaagaatatgtcttatcggtaaccaacagaacgccaggccacggcccctgtgttagtgatatataaagacatgagcgcctgagagactccctgagcgtacttctcgtcggcctccgagtcctacgagggacacgcgtagtccgtacggttacgtaactacgtacgtaggtacgaacggttcccgaagggtacgaagggaagggaccggaacggtaccgttaggtaactttaacgtttaaccgtagttaaacccaaaagtacgggtaaacgtaacgtaagggttaacggttaaggttaaccttgtaagggtttggggttaccgggttacggggacggggtaaaccgggtaaccgtaacggtacccggtaccggttccccggttaccggttaacgggtacccgtacggtaaccccggaacggtcccgtcccccggttccccccgttaccggg

SEQ ID NO: 201387 - DNA, 784 bp, Homo sapiens
  misc_feature: GYAE6OF01CJWBH.21.46.E02.1.454.CMB.1.raw
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccaggacagaccggccaggactccacctgctctgcagatggactgaacaaagaatntcgcttagttacggtaaccaanagacgccgacgccgacgcctggtgtagtgaatataagtaaacgacgtacaggacggtacgaccctacgaacgaagtacctcccgtaggacgacgttacgtttcctcgtcgggtaccctaccgtacgacgtacggaacgggaccgtacgaccggtaacgttaccgtaacgggtttacgaacccttaagtacgtacgggttaaggaaacccggtaccggtaacgggaaccgggaaagggacccggggaacggtaacgggttcgttacgtaaacccgttttaatttaaccgtttaaccggtaaacgaaaacgtaacggttaaacggaaacggtaagggttaacgggtaacgttacttaacggttagggtttccgggggttacggttaccgggggtaaaccggggaacgggtaacccgtaagggtcccggtttaccggtaccccgggttacggtaaccgggttacccgaaaccggtaccccggaaccggttcccggttcccccggtccccggttacccgg

SEQ ID NO: 201388 - DNA, 746 bp, Homo sapiens
  misc_feature: GYAE6OF01AQBWD.21.46.E02.1.454.CMB.1.raw
  modified_base (229)..(229): a, c, t, g, unknown or other
  misc_feature (229)..(229): n is a, c, g, or t
  modified_base (688)..(688): a, c, t, g, unknown or other
  misc_feature (688)..(688): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcaggtcgtccccagggacacgacggccaggatccacctgctctgcaganggactgaccaaaagaaacttatggtactttagttacggtaaccaaacagaacgccgacggcccgacgggcccccttggttaggtttagtaggtaactttaagtaaacgttaaaagaccgtaacgttaggaacggtaccgggtacccccttagaaacggtaacgaactttccccggaggacgtaccgttaactttccgtaccgtcggtcctacccgaggtccgtacggaacggggacctagaccgtacgttacgtaccggtttacgaaccttacgttacgaaggttacggaaccggttaccggaacgggcggaacgggaaacgggtccgggaagggtcccgttaaggtacctttaagttaaccgtttacgtaaaccgtaaacgtaaggttaacgaacgtaagggttaacggtacgttacgttcgtaggttgggttacggggtcggacgggtacggtacgngtacgtacggtcccgttacgacggtacgaccgtaccgagtccgccggtccccgttccg

SEQ ID NO: 201389 - DNA, 641 bp, Homo sapiens
  misc_feature: GYAE6OF01C7WXH.21.46.E02.1.454.CMB.1.raw
  modified_base (179)..(179): a, c, t, g, unknown or other
  misc_feature (179)..(179): n is a, c, g, or t
  modified_base (335)..(335): a, c, t, g, unknown or other
  misc_feature (335)..(335): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggccctcctatgagctgacacagcccaccctggtntcagtcgtccccgaggacagacggccaggatcacctgctctgacagatcggactgaccaaaagaaatatgtacttagttacggtaaccaacgaagacgaccgacggccgacggtcccctgtgttagtgatataagtaaagacagtgagacgcctanagagctccgtgaacgtctattccgtcgtacgccgttaccacgtccgtacggaacggaacgagaccgtaggtaccgtacggtttacaacgttacgtacgtaaggttacgaacggtacgacggacgaacgggagggaacggtacggtcgtaacgtacgttaattacgtacgtaaacgaacgtaacgtaagacgtaagtacggaagttacgttacgtaggttgggtacggttcggaccggaggacgaacggtcgacggtaccgtacgtacggaccgaccggaccgtaggcccgttcccgcccgttccgg

SEQ ID NO: 201390 - DNA, 760 bp, Homo sapiens
  misc_feature: GYAE6OF01CGI8D.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagccaccctcggtgtcagtcgtcccaggacagaccggccaggatcacctgctctgacagagtacggactcgaccaaaagtaaatgtcgtactttaagttacggtaaccaaacgaagaaaccgaccgaacgggaccaccgggtcccccgttaggttaccggttaaggttagtaatttaacgttaaaagttaaaacggaacctaacgttacggaacggtaccgggtccccttaacgaaggtaacggtaccgttacccgtaggaacggtaccgttacgtttccgtcgttcggaaccgttccgacggtccgttacggaacggggtacctacggacgtacgttacccgttacggtaacgtacttacgtactacgggtaacgtaacggttacccgaacgggtacgaagggtacggaaccgggttaggtacgtaaccgtaacgtttattaccgtgtaaaccgaagtaacgtaagtaacgagttaaggtactacgtacgtaggttacggggttgtacggggcgggtaacggacgtacgtaggtaccggtccggttaccgtagggaccgaccggtacgacggtaccctcccgggtccccgttaccgg

SEQ ID NO: 201391 - DNA, 783 bp, Homo sapiens
  misc_feature: GYAE6OF01DFGDG.21.46.E02.1.454.CMB.1.raw
  modified_base (767)..(767): a, c, t, g, unknown or other
  misc_feature (767)..(767): n is a, c, g, or t
tcagtcgtcgctcgcacgaccggtgctcgatttagactcatctacagggaaggggggtgggtccaggaggcagaactctgggtgtctcaccatggcctggatccctctacttcctcccctcctcactctctgcacgaggctctggacggcctcctagtgagctgaacacgacgcccacccgtcggtgtacaggtcgtcccccgaaggaccacggaccggccgaaggtactaccgacctgccttcgtgacagacgtcgggactacggaacaaaaagaaatacgtcgtactttagtacggaaccaaagagaacgccgaggtacccgacggcccttggttaagttaggtacgtaattaactaaagtaaaacgacaccgttaggaacgaccggtaccccgtaaggaatacgtaacgtcccgtaaggagtacccgtttaacgtttcgtcctgggacccttacggacgcgtaaccggaaggggacacggtaccgaatttaccggtaaccggttaaagacgttaaccgtaggtaacggtaacgtaaacggtccggtaaacggtaccgaaagggaacgggaaccgggaggtaaccgtaacggtaacgttaagttaacttacggaaacgttaaacgaagtaacgaacgtaacgggttagtaacggttacgttacggtagggttaccgggttcggttacggggacgggaacggtaaccgaacggtccggtaacgtcccggttaaccgtaggtaccgaacggacccgtaacggtcccnccgtacccccggtcgg

SEQ ID NO: 201392 - DNA, 764 bp, Homo sapiens
  misc_feature: GYAE6OF01C6WES.21.46.E02.1.454.CMB.1.raw
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtcccaggacagacggccaggatccactgctctgcagatggactgaccaaaagaaatntgntttattggaaccaanaagaagccgagggaccacggccccttggtgttagtgtaattaataagtaaagactacgtagaggtaacggccctacgaagaacgtactcccgtagacggtcgtactttaccgtcgtcgggacccttccgaagtccgtacggaacgggactaagtaccgtaggttaccgtaacggtttacgtaacctttagtacccggtaaggttacggtaaaccggttccgaacgggacgaaacgggtacgggtaccgggaacgggttaccttaacggtaactttaacgtttacgttacgaaaccgttaaaagtagtaacggaacgtaaggggtaacgttaacggttacttacgttagggttttacgggggttacgggttcggggaaccgggtaacggggtaaccgtaaacggtacccgggttaacggtacccggtttaaccccggtaagggttaccgtaaacccgggaccccgggtaacgggtacccgtcccggtccccccggtttaaccggg

SEQ ID NO: 201393 - DNA, 658 bp, Homo sapiens
  misc_feature: GYAE6OF01EXLR0.21.46.E02.1.454.CMB.1.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatccacctgctctgcagatggactgaccaaaagaactatgtactttagtggtaccaacagaagccaggccaaggcccctgngtttaacgtagtataataangtaagaacacgtacgagacgacctacgacgacgacgtaccgtacgtacgtacgtacgtcttcgtcgtccgtcgacgtacgacggacggaacggtacgtacgtacgtactacgtacgtactacgtacgtacgtagtaacgtacggacggacgaacggaacggaacggacgtacgtacgtaacgttaacgttaacgtacgtaacgtaaacgtaagtaacgtaacgtaacggtaacggtaacggttacgtacgttagggttcgggttacgggtaccgggacgggtacggtaacggaacgtacgtaccggtaccgtaccggtaccgtaccgaccgacccgtacccggtccgtcccg

SEQ ID NO: 201394 - DNA, 695 bp, Homo sapiens
  misc_feature: GYAE6OF01EZN8I.21.46.E02.1.454.CMB.1.raw
  modified_base (218)..(218): a, c, t, g, unknown or other
  misc_feature (218)..(218): n is a, c, g, or t
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttcctccccctctcactctctgcacaggctctggaggcctcctatgagctgacacagcctaccctcggtgtccagtcgtcccaggacagacgcagatccactgcttcngcagatggactgaaccaaagtaactntgtactttagtacgtaaccaacgagaacgccgacgccgaacggtccccttgtcgttagtgtaataataactaaacgacacgtaggacgtaccgccctagagtacgcctaccgagacgtacgtacttcctcgtcggtacctaccgacgtccgtaacggacgggaaccgtacggaccgtaacgtttaccgtacggtttaccggtaacttacgttaccggtaggtaacggtaacccggttaccggaacgggacggtaaagggaaccgggtacggacggttacgttacgttaattaaccgtttacgaacgttaacaaacgtacgtaaggacgtaggtaccggtaagttacttacggtaggtttcgggtaggttaccgggaggtaaccggtacgtaacgccggttacgtcccgttacggtagtccgacggacccgtagccgtacccgcccgttacg

SEQ ID NO: 201395 - DNA, 822 bp, Homo sapiens
  misc_feature: GYAE6OF01BNP94.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccgaggacaggacggccaggactcacctgctctgcagatggactgaccaaagaatagtgtacttagttcggtaaccaacgagaacgccgaacggacccgacggtcccctaggttagttaacggtgtaagttaataagtaaacggactaacgtaggaacgtaccgggacccctagaacggacgtaccgtacccgtaggacgtaccgtattccgtccgtacggtccctacgacggtcctacggaacgggacgacggtaccgtacgttaccgtaacggtttacaaccgttacgttaccggtaaggttaacggaaaccggttccgaagggtaccggaaagggaaccgggtacggtaacggttaccggtaacggtaaccctttaacgtttaaccggtacgttaaaaccgtaaacgggtaacgtttaacggtaaacggtacgggtttaaccgggaacggtttaaccgtacgggtttagggttttaccgggggttacggggtttacccggggacggggtaaaaccgggtaacccgtaacgggtacccgtacgggttaaaccccgttccgggtaaacgggtaccgtacccgggacccggtaaaccggttcccgtaacccccgggtccccggtttaacccggg

SEQ ID NO: 201396 - DNA, 715 bp, Homo sapiens
  misc_feature: GYAE6OF01EVCIR.21.46.E02.1.454.CMB.1.raw
  modified_base (179)..(179): a, c, t, g, unknown or other
  misc_feature (179)..(179): n is a, c, g, or t
  modified_base (243)..(243): a, c, t, g, unknown or other
  misc_feature (243)..(243): n is a, c, g, or t
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccacccgtcggtntcagtcgtcccaggacaggacggccaggatccacctgcctctgcagatggactgacaaagaatntgtactttagtacggtaaccaacgaggaaacgccgaacggccaacggccccgttggttagtttaacggtgtaataagttaaacgtaaaagacctaacgttggaacgtaccggtcccttagaacggtacgtaccgttcccgtggacgtccgtaactttccgtcgtcggtacctaccgagtcctacggaagggtaccncgtacgtagttaccgtaacggtttacgtaactacgtaccgtaagtacgtaaacggtccgtaacggacgaaggaaccggaggaacggtctacggtaactacgttacgtacgtaaactaaacgtagtaacgtaacgtaagttaacggtaacgttactacggtacggtttcggggtacgggtacgggacgggtaacggtaaccgtacggtacgtaaccggtacccggttacgacggtacctaccgggtaccaaggtccccgtccggtcccccgttacgg

SEQ ID NO: 201397 - DNA, 730 bp, Homo sapiens
  misc_feature: GYAE6OF01A7TPD.21.46.E02.1.454.CMB.1.raw
  modified_base (229)..(229): a, c, t, g, unknown or other
  misc_feature (229)..(229): n is a, c, g, or t
  modified_base (344)..(344): a, c, t, g, unknown or other
  misc_feature (344)..(344): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggccctcctatgagctgacacacgcccaccctcggtgtcacgtcgtcccaggacagacggccaggactcaccgtgctctcgcaagntcggactacggaaccaaaaggtaaattgtagtcctttaagttacgggtaacccaaaacgagaaacggccaacgggtacccgaccggaccccgttgttacggttacgtaggttaanagttaaaactaaacgctacgtagggaacgtaccggtaccctagaacgtaggtacctcccgtagaaccgtntacgtttccncgtacggcttaccgagtcgaacggtagactagctaacgtcgtacgtcaactagacgtagacgtaacgtacggacggacgtaaagggaggtaccgacggtacgttacgtaaactttagtaaccgtagtaacccaaagtaccggggtaataacgtaaggttaacggtaaccgttacgtcgttagggttaccgggttcggttacgggaccgggttaaacgggaacctaccggacgttacggtaccccggtaacgtaggtaccctaaaccggccggaaaccgggtcctaaccccggtcccgggtaacccg

SEQ ID NO: 201398 - DNA, 670 bp, Homo sapiens
  misc_feature: GYAE6OF01DLW1D.21.46.E02.1.454.CMB.1.raw
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
  modified_base (648)..(648): a, c, t, g, unknown or other
  misc_feature (648)..(648): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctagtgagctgacacacgcccacccgtcggtgtcagtcgtcccaggacaggacgccaggacncacctgctctgcagntggctggaactaaagaactgtgacttagttcggtaaccaacgagaacgaccgacggccacggacccctgtcggtagtagtataacgtaataaacgaactacgtagaggacggtacctacgaagtacgactcccgtagacgacgtacttcgtcgtacgtccgtacgacgtacgtacggaacgggacgtacgtacgtacggttacgtaacggttacgacgttactacgtaagttacgtaaccgtccgaaggtaccgaaggacgggtaacgacgtacgtaacgtaacttacgttaacgtagtaacccgtaagttaacggtaacgtacggaacggttaacggtacgttaacgtcgttagggttcgggttacggtcgggacgggtacggtacgacgtggaccgtccgtacgacgacgtcgaccgngtaccggcccgtcccgtaccgg

SEQ ID NO: 201399 - DNA, 774 bp, Homo sapiens
  misc_feature: GYAE6OF01B88KT.21.46.E02.1.454.CMB.1.raw
  modified_base (108)..(108): a, c, t, g, unknown or other
  misc_feature (108)..(108): n is a, c, g, or t
  modified_base (135)..(135): a, c, t, g, unknown or other
  misc_feature (135)..(135): n is a, c, g, or t
  modified_base (184)..(184): a, c, t, g, unknown or other
  misc_feature (184)..(184): n is a, c, g, or t
  modified_base (498)..(498): a, c, t, g, unknown or other
  misc_feature (498)..(498): n is a, c, g, or t
  modified_base (528)..(528): a, c, t, g, unknown or other
  misc_feature (528)..(528): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
tcagtcgtcgctcgcacgaccggtgctcgatttagactcatctacagggaaagggggtgggtccaggaggcagaactcgtgggtgtctcaccatggcctggatccctntacttcctcccctctcactctctgcanaggctctgacgtcctctatgagtctagacacacgccctacccgtgggtntaccaggttccgtaccccgaagggaccacggaaccggccgtaaggataccgacctggccttgcgagtaagcgtaggacctagaaccgtaaaataattcgttagtactttaacggttacggtaaccaaacgaacggacgaaccggtacggaccgtaccggttccccgttggtttaggtaacgttgtaaagtttaagttaaaaccgaaaggtaaaccttacggtaacggacggtaccggtaccctaagaagtaccgtactccgttaggaacgtcgtactttcgaccgtgaccctacgtcgacgacggaacggtacncgtactacgtacgttacgactactatacgngtacaacgtcgagacggaaagcggtaagngtntacggtaatttcgtaacacggtaacgtaacgacgtaacgtaagtaacggttacgaacggttaccgttaaggtttgggaacgggtttaccggggagggtaaccgggtaacgggtaaccggtacgtcgggtaacccggttacgttaccggggtaacgtacccgggtaacccgtaacggacccgggtttccctacccccggggttccgttaacccgg

SEQ ID NO: 201400 - DNA, 730 bp, Homo sapiens
  misc_feature: GYAE6OF01B08BR.21.46.E02.1.454.CMB.1.raw
  modified_base (325)..(325): a, c, t, g, unknown or other
  misc_feature (325)..(325): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtgtccccaggacagacggccaggatcacctgctctgcagatggactgaccaaagaatatggcttattcggtaaccaacgagaaacgccgaaggccacgggcccctgtcgttagtgattataataaagacacgtgacgaggccctnagagactccctgacgcgtactttctcgtacggtctccgagtccgtacgaggggtaccaaggcgtaacggtcctaacggtttcgaaccgttaatccgtaaggttacggaaacgttacccgaagggtacgaagggaacgggaacggtacgggtacttacggtaactttaacgtttaacgtagggttaaccctaaaagtacggttaaacggaaccgtaagggttaacgtaacgggtttaacccttcggtaacgttttggggggtacggtttaccggggaccggggtaaaggggtacccccgtaaagggtcccggttaccgggaaccccgggtttcccggtaagggttaccccgaccgggtaaccccggtaaaggggtccccttacccgggtcccccccggttaccggg

SEQ ID NO: 201401 - DNA, 786 bp, Homo sapiens
  misc_feature: GYAE6OF01C03I9.21.46.E02.1.454.CMB.1.raw
  modified_base (220)..(220): a, c, t, g, unknown or other
  misc_feature (220)..(220): n is a, c, g, or t
  modified_base (248)..(248): a, c, t, g, unknown or other
  misc_feature (248)..(248): n is a, c, g, or t
  modified_base (365)..(365): a, c, t, g, unknown or other
  misc_feature (365)..(365): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacacgccaccctggtgtcagtcgtccccaggacacgacggccaggactccacctgctcngacagatggactgaacctaaaagaaatntcgtacttaagtttacggaaccaacgaagaacgccgaaggcccacggtccccgtgttacggttatagtaataagttaaaacgtaaacacgtaacgtaggacggtaccggcccctaanaacggacgtacctccggtagacgtcttactttcctcgtcggtaccctcgaacgtcgtacggaaggggaccaggtcgtaaccggttactacgggtttcaacgttacgtaccggtaagggtttacggaaaccgtaccggtacgggaacgtaaacggggaaccggtaacgggaacggtccgtttaaacggaaaccttttacgttttaaacgtaaccgttaaaaccggaaaaggtttaaccggaaagtaaaccggtaaagggtacggtaaagggtttaacccgttcggtttaaggggtttccggggttacgggttacgggaccgggggacggtaacccgtaggttacccggtacggtacccggtttaccggtaaccggcgtaaacccgggacgtaccgttccggtaccccgtccccgttaaccgg

SEQ ID NO: 201402 - DNA, 638 bp, Homo sapiens
  misc_feature: GYAE6OF01BJTGZ.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaggggtgggtccaggaggcagaactctgggtgtctcaccgatggcctggatcctctacttctcccctcctcactctctgcacaggcctctgaggcctcctatgagctgacacagccaccctcggtgtcagtcgtccccagggacagacggccaggatcacctgctctgcagatggactgaccaaagtaatntgacttatcggtaccaacagacaccgaggtccacggcccctgtcgttagtcgaatagtaataaggaccactgagtacggccctgagtacgactccgagacgacgatttctcgtggtacctccgagtccgtacgacgggacacgtcgagtacctacggtttagactatcgaacgttagaacggtcccaaagggtccgtaaggaacggtaacggacgggtcccgttagtaaccttacgttaccgttacgtaactaacgacgtaagaaccgtagtacgtagttacctacgtacggttacgggtcggtcgggtacggtaacgggaacccgtaaggtcccgagggttacccgtccgttaggcccgtaacgggaccctagggacctccggtcccccttacggg

SEQ ID NO: 201403 - DNA, 735 bp, Homo sapiens
  misc_feature: GYAE6OF01CB5NX.21.46.E02.1.454.CMB.1.raw
  modified_base (179)..(179): a, c, t, g, unknown or other
  misc_feature (179)..(179): n is a, c, g, or t
  modified_base (245)..(245): a, c, t, g, unknown or other
  misc_feature (245)..(245): n is a, c, g, or t
  modified_base (309)..(309): a, c, t, g, unknown or other
  misc_feature (309)..(309): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctctatgagctgacacagcccaccctcggtntcagtcgtccccaggacagacggccaggactcacctgctctgcagatggactggaccaaaagaatntagtctttaagttcggtaaaccaacgaagaacgccgacggccgtacggtccccttgtagttagngtaatataataaacgacagtaggacgtacggccctagagacgactccgtagagtactacttctcgtcggccttccgaagccgtacgacgggaacagcctaggtacctacggttacgacttacgtacgacgtagaacggtccccgaaggaccgtaagggaacgggacgtaacgggtaccgtagtaacctttaacgtttaacgtaacgttaaccgaaaacggttaaggtaacgaacgggttaaaggttaacgggtaaaccgtttacggttaacgtttaggggtttaacggggttacgggtaccggggtaccgggaaacgggtaaccgtaacgggttcccgttaccggtacccggggttacccttaacgggaccggtaacggtaacccccgttagggtccccgttacccgggtccccccgttacccggg

SEQ ID NO: 201404 - DNA, 718 bp, Homo sapiens
  misc_feature: GYAE6OF01EUUFP.21.46.E02.1.454.CMB.1.raw
  modified_base (225)..(225): a, c, t, g, unknown or other
  misc_feature (225)..(225): n is a, c, g, or t
  modified_base (269)..(269): a, c, t, g, unknown or other
  misc_feature (269)..(269): n is a, c, g, or t
  modified_base (385)..(385): a, c, t, g, unknown or other
  misc_feature (385)..(385): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacccgtcggtgtcagtcgtccccaggacagaccggccaggatccactgctctgcagntggactgaaccaaagaaatatgtactttatttcggaaccctaanaggaaacgtcccagggacccaacgggtccccttaggttacgtttaggtgtaacttaattaagaaaacggcctaacgtgacgtaacggtcccctagaagagacgttcccgaggtacnccgtaactttcgtcgtcgggtcctccgaagtctaccggaagggacctaggtccgaagtcccgttaacggttacgtaacttaactcggtaagttacggaacgttcgaacgggtacgaaggtaaccgggacgtacggtctacggttaccttaagtttacctaacggttaccaaaccgtaggtttaagaactaacggggtagttaacggttaacctcggttaacggttggggttacggttacggtacgggaaacggtaccgacgggtcgtaccgtacgttacccggtaggaccgttaccggacccgtaagggtcccttacccggccccgttacggg

SEQ ID NO: 201405 - DNA, 830 bp, Homo sapiens
  misc_feature: GYAE6OF01APAT5.21.46.E02.1.454.CMB.1.raw
  modified_base (155)..(155): a, c, t, g, unknown or other
  misc_feature (155)..(155): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatganctagacacacgcccaccgttgggtcgtcacggttcgtacccgaaggacacggaccgggcctaagggacttccgacctggacctcgtggaccagtagtcggacttcgaaccgaaaagtaattcgtcgtactttaacgttacggtaaccaaccgagaaccgcgaacggccgtaccggtccccgttggttagttacggagtactaacgtaaacgtaacgaaccgtacgtaggaacggaccggtacccttaggaacgtacggaccttaccggtacggtacgtaccgttaacgttccgttacggtaccggttacacccgtacggtaccggttacggaacgggtactaaccgaacggtacgttacccgtacggtttacggtaaccttaggtaacgtaacgggttacgacccggttaacgaacgggttaccgaagggtaacggacggttaccgggtagttacgttaaccttaacgtttacggttaaccgacaaaacggtttcggactaacggtacggttacgttaacgggaccttaggggttacggttagggtttaaccgggtaggggcccgggtaagttacccgggttaacgtttaccggtccgggttaaaacgggccggttccggaaaacccgttccgggaacggttacccgtcccgggttacgggtacccgttaacccg

SEQ ID NO: 201406 - DNA, 739 bp, Homo sapiens
  misc_feature: GYAE6OF01ATK4Y.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagaccggccaggactcacctgctctgcagatggactgaccaaaagaatntgtacttagttacggtaaccaacgagaacgccgacggccacggcccctgtcgttagtgatataataaagacacgtgagcggtcctagagacgactcccgagacgtacgtattccgtcgtacggcctaccgagtcccgtacggaacgggacacggaccgtaggtaccgtacggttacggtacttacgtacgtaggttacggaacgtccgaagggtcaacgggtacggaacgggacgtacgtacgtaacttaacgtttaacgagttaaccaaacggtaggtaaacgaacggtaaagggtaacggtacggttaacttaccggtaggttttacgggggtaccggttaccgggggtaaccgggtaacggggtaaacccgtaacgggttacccgttaaccgggtaacccccgggtttaccggttaaacggtaccccggtaaaccgggacccccgttaaacggggtccccgttaccccgggtaccccccggttaccccgggg

SEQ ID NO: 201407 - DNA, 809 bp, Homo sapiens
  misc_feature: GYAE6OF01DKXOS.21.46.E02.1.454.CMB.1.raw
tcagtcgtcgctcgcacgaccggtgctcgatttagactcatctacagggaaagggggtgggtccaggaggcagaactctgggtgtctcaccatcggcctggactcctctacttcctccctcctcactctctcgcacgaggctcgtggacgcctctatgacgctacgacacgacgcctacccgttcgggtcgtccgaggttccggtaccccgaggaccgacgggaccggaccgaaggtacctaccgtaccgttcggtccttccgtgaccgaaggtacgtacgggacctacgaaaccgtaaaaagtaaacttcgtacgttactttacgttaacggtaaccaacgaacgaacgaccgacggaccgaccggtccgttaggttacgttagtagtaactaactaacgtaaacgtacgtacgtaggaacggtaccggtacctacgaacgtacgtaccgtaccgtacgacgtacgttacgttcttacggtcggtacctaccgtacgtcggtaacggtaacggacgaacggtacgtacgttacgtacggttacgtaacgttacgtaacggttaacgtacgtaacggtaccggaacggtaacggaacgggacggaacgggtacgtacgtacgtaacgtttaacgttaacgtaacgtaaccgtaaaggtaacgtaacggtaacgtaagggtaacgtaacgttacgttacggttacgggttcgggttacggtacgggacgggtaacgggacgtacggtaccggtacggtaccggttacgtacgacgtaccggtaccggtacgtaccgtcccgtcccggtcg

SEQ ID NO: 201408 - DNA, 760 bp, Homo sapiens
  misc_feature: GYAE6OF01BL7DK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggaggcctcctatgagctgacacagccaccctcggtgtcagtcgtccccaggacagaccggccaggactccacctgctctgcagatggactgaccaaagaatactgtactttagttaggtaaccaacgaggaacgccgacgggaccacgggtcccccttggttacggttaacggttagaattaacgttaaagtaaaacggtacctaacgttaggaacggtaccggtcccctacgaaggacgtacttaccccgtaggacgtaccggtactttccgtacgtcggtacccgtccacggtccttaccggaacgggacacggacgtacggtacctacggttacgaacttacacgtaggttacgaacggtacccgaggaccgaaagggtaacgggacggacggtcctacgtaacgtttacgttaacgtacgttaaccaaacggttaaggtaacgtaacgtaaggttaaacgggtaccggttacgtaacggttagggtttacggggttacggttaacggggccgggtaaccggaaccgtacgggttccgtaaccggttcccggtaccgttaacgggacctacgggacccgtaacgggtcccgtacccggtcccccggttacccgg

SEQ ID NO: 201409 - DNA, 741 bp, Homo sapiens
  misc_feature: GYAE6OF01AQ9W8.21.46.E02.1.454.CMB.1.raw
  modified_base (412)..(412): a, c, t, g, unknown or other
  misc_feature (412)..(412): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgacggtcctcctatgagctgacactagcccaccgtggtgtcagtcgtcccaggcaggacgccaggactcacctgctcgtgcagtatcggactgaaccaaagtaattcgtgtacttagtacggtaccaacgagaacgcgaccgccgtacggtacctgttgtagtacgtaagttataactaacgactacgtaggacgtccggaccctagacgacggtaacctccgagacgtcgtacgttctacggttcggcttacacggtcgtaacgagggacngacgtagtctaccgttgacttacgtacagtaacggacggtacccgagggcggtaaggtaaccggtagggtaacctacgttacggtaaccttttaacgttaacgtagttaaaccccgtaaaggttacgggttaaccgaaggttaaccgggtaagttaaaccggttccgttaggttaacggttttcgggggtaaccggtcggggaaacccggggttcctaacccggggtaaattacccggggttccggttaaacccgtcccggggttaaacgttccccgggaaacgttaccccgggaaaggttccccgttaccccgggtccccgttacggg

SEQ ID NO: 201410 - DNA, 728 bp, Homo sapiens
  misc_feature: GYAE6OF01CQI9L.21.46.E02.1.454.CMB.1.raw
  modified_base (253)..(253): a, c, t, g, unknown or other
  misc_feature (253)..(253): n is a, c, g, or t
  modified_base (430)..(430): a, c, t, g, unknown or other
  misc_feature (430)..(430): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacacacgccacccgtcggtgtcagtcgtaccccaggacaggaccggccaggactcacctgctctgcagatcggactcgaaccaaagtaaatntgtacttattacggtaaccaacgagaaacgccaaggccgacggtccccgttgtacggttagtagaatataataaacggaccaagtaggaaggtacggtaccctacgaagtaacggacttacccgtaggataccgtatttcctcgtcggcctaaccgacgtccgtacggaacgggacngtacgtaacgtacgtacggttatacttacgtacgtaggttaacgtaacctaccggaggtaacgaggacggaccggaggtactacgtacgttaagttacgtacgtaactaaacggtacgtaacgaagtaacggtagtaacggtactttacggaaggtttcgggttacggttacgggacgggtaaacgggtaaccgtaaccggtacgtttacccgggtaccgttacccgggtaaagttacccggaacccgggtaaacccggaccggttttacggcccccgggttaaccccggttccccgg

SEQ ID NO: 201411 - DNA, 728 bp, Homo sapiens
  misc_feature: GYAE6OF01BBK47.21.46.E02.1.454.CMB.1.raw
  modified_base (180)..(180): a, c, t, g, unknown or other
  misc_feature (180)..(180): n is a, c, g, or t
  modified_base (218)..(218): a, c, t, g, unknown or other
  misc_feature (218)..(218): n is a, c, g, or t
  modified_base (254)..(254): a, c, t, g, unknown or other
  misc_feature (254)..(254): n is a, c, g, or t
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtntcagtcgtccccaggacagaccggccaggatcaccgtncctctgccagatggactcgaaccaaaagaattacgngtactttagttacggtaaccaacgaacgaacgccgacggaccaccggcccctaggttcggtttaagtntaattataaacgttaaacgactaacgtcggaacggacggaccctagaacgagtacctacccgtgacgtcgtaacgttcgtcgtcggcctcgtaggtcctacggaacgggaccaggactaccggtacgtaacgttacggtaactacgttacgtagtacgtaacggtaccgtacggacggaggaacgggacggtacggtcgttaacggtaacctttacttacggttaacaacgtaaacgtagtaagacgtaaggtaacgggtacttacgttacggtaggtttaggggcggttacggggacgggtaaccggaccggtaaggtcccggttaccggtaacccggttccggtaacggttaccggaaccggttacccggaaggtccccgttccccgggtccccggttaaccgg

SEQ ID NO: 201412 - DNA, 691 bp, Homo sapiens
  misc_feature: GYAE6OF01CEA2Q.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaatatgcttattacggtaaccaacgaagaacgccgaggccacggcccctgtgttagtgtataataataaagacacgtaggacggacggtccctagagaacgtactccgtagacggcgtactttcctacgtcggtcctccgacgtccgtacggaacgggacgacggtacgtacggttaccgtaccggtttacggaaccttaacgtacggtaaggtaacggtaaccggttaccgacgggtacggaaggaacgggacgggacggtacgtagtaaccttagtttaccgtacggtaacgtaaacgtacgtaagtaacgtaggtaagtacggttaacttcggtagtttacgggtggttacgggtaccgggagggtaaccgtacgacgtccggtacccggttacccgtagggtaacccgtacggaacccggtacggtcctcccggtccccggttacccgg

SEQ ID NO: 201413 - DNA, 714 bp, Homo sapiens
  misc_feature: GYAE6OF01AIJ48.21.46.E02.1.454.CMB.1.raw
  modified_base (137)..(137): a, c, t, g, unknown or other
  misc_feature (137)..(137): n is a, c, g, or t
  modified_base (182)..(182): a, c, t, g, unknown or other
  misc_feature (182)..(182): n is a, c, g, or t
  modified_base (264)..(264): a, c, t, g, unknown or other
  misc_feature (264)..(264): n is a, c, g, or t
  modified_base (672)..(672): a, c, t, g, unknown or other
  misc_feature (672)..(672): n is a, c, g, or t
tcagtcgtcgctcgcacgaccggtgctcgatttagactcatctacagggaaagggggtggggtccaggaggcagaactctgggtgtctcaccatggcctggatccctctacttctccccctcctcactctctgcacnggctctgaggcctcctatgagctgacacacgcccacccgtcggtntcagtcgtccccaggacacggacggccgtaggactccacctcgcctcgtagcagacgtggacctagaaccaaaaggaaattntagttaccttagttacggtaaccaacgagaaccgccgacggccgaccggtccccgtgttacgttaggtagtaattaataagtaaacgacgaactggaacgtaccgtacccgtagaacggacgtacctacccgtaggtaacgtccgttactttccgtcgtacggtaccctccgaacgtcgtaaccggacgggtaccgacgacgtacggtaccgtacggtttacgaaccttaggttaccgagtacggacgtaaccgaggtaacgaggtaagggacgtacggtacgtagtaacttcgttacgtacgtaacgtaacgtacgtaagacgtaagtacggtacgttaccttaggtagggttcggttcggtaaccgggtgggaacgtacgtaaacggtcgtaccggaccgttacgnggtacccgtagacccgtacggtctccccggtccgtaacccgg

SEQ ID NO: 201414 - DNA, 856 bp, Homo sapiens
  misc_feature: GYAE6OF01ALDJG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactggaccaaaagaaatatgtacttagttacggtaaccaacagaacgccgacggccacggtcccccttggttaggttaagtacgtaattaagtaacgtaaaagacctaacgttaggaacggaccggtacccctacgaaggtacgtaaccttcccgtaggaacgtcgtaactttccgtcgtacggccttaccgagtccgtacggaacggggtaccacggtacgtacgttaccgtacggtttaacgaacctttagtaccggtaacgggttacggtaaacccggttaccccggaagggtaccggtaaacgggaaacggggacccgggtaaggtacccggttaacgtaaacccgtttaccgttttaaaccgtaacggttaaacccaaaacggttaacggtaaacggtaaaccggttaaggggttaaacggttaaacgggtttaaccgttaccgttaaggggttttacgggggttccgggttacccgggggaaccggggtaaacgggtaaccccgtaagggttaccccggtaaccgggttaaccccgggtttaccggtaacggggtacccgtaacccgggtacccccgggtaaacggggttcccttacccccggggtccccccgttaaccgggg

SEQ ID NO: 201415 - DNA, 684 bp, Homo sapiens
  misc_feature: GYAE6OF01AV4Z2.21.46.E02.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatccacctgcctcngcagatggactgaccaaagaatactgtcttattacggtaccaacagaacgccgacggccacggtcccctggtacgttagtgaattactaacgtaaagacctacgttggaacggtacggtcccctagagtacgacgtcccgttagacgtaccgtattcctacgtcgggtcctaccgacgtcctacggtaacggggactacggacctacggtacgtaccggttacgaacttacgtaccgtaggtacggtaacgttacccggaagggtacctaacgggaacgggacggaggtccgtacgtaacttacttacgtataaccgtaaacgtacggtaacgaacgtaaggtacgtaacgggttactcggtaggttcgggttacgtccggggtaccggtagggaccgtacggtacgtacggtccgttaccggttacggcgaacgtcccgtaaggcccttccggccccgttccgg

SEQ ID NO: 201416 - DNA, 828 bp, Homo sapiens
  misc_feature: GYAE6OF01CAGN8.21.46.E02.1.454.CMB.1.raw
  modified_base (138)..(138): a, c, t, g, unknown or other
  misc_feature (138)..(138): n is a, c, g, or t
  modified_base (142)..(142): a, c, t, g, unknown or other
  misc_feature (142)..(142): n is a, c, g, or t
  modified_base (631)..(631): a, c, t, g, unknown or other
  misc_feature (631)..(631): n is a, c, g, or t
  modified_base (675)..(675): a, c, t, g, unknown or other
  misc_feature (675)..(675): n is a, c, g, or t
  modified_base (746)..(746): a, c, t, g, unknown or other
  misc_feature (746)..(746): n is a, c, g, or t
  modified_base (806)..(806): a, c, t, g, unknown or other
  misc_feature (806)..(806): n is a, c, g, or t
tcagtcgtcgctcgcacgaccggtgctcgatttagactcatctacagggaaagggggtgggtccaggaggcagaactcgtgggtgtctcaccatggcctggactccctctacttcctcccctcctcactctctgcagngctntgacgcctctagtgagctagacacgacgccctaccgtcggtgcgtaggtcccgacccgaaggaacgacggaccggaccgtaaggtacctccaccgttgtccttcgtcgactaggagtaggacctaacgaaacgtaaaagtaagtttacgtacgttaacgtttaacgttaaccggaaccgaaacgaacggaaccgaccggaccggacccgtaaccggtcccgttaggttaacgtaggttaataaagttaaacgtaaagtaaacgtaaccacggtaacggaccggtacccggaacctaacggtaaggtaacgttaccccgttacgtaacgggtacttaaccggttaactttcccggtaaccggtccgtaacccgtttagaaccggtacgaacggggtacgacgtacggtaacgtaccgtacgtaacgttacaacgttacgacggtaacggttaaccgacggaaccggaggtaacgaacgggagtaaccggngggtactaaccaagtttaactacggtaaacaccgaaaggttaanaaccgtagggaacgtttaccggaagttaccgttagggtcggttaacgggaaggggttcggaaaccggggtnaacccggtaacgacgggtaccggtcccgtaagggccgtaacccgacgacccgggtacccnccgttaccgccccgggttaacc

SEQ ID NO: 201417 - DNA, 841 bp, Homo sapiens
  misc_feature: GYAE6OF01DY3EN.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtcccaggacagcggccaggactcacctgcctctgcagatggactgaaccaaaagtaaacttgtcgtactttaacgttacggtaaaccctaaacgaaggaaccgacccgtaacgggcccgtaaccgggtccccgttggttacggttaggttagtaattaaattaaagtaaaacgactacgtaggacgaccggtaccctagaagaacgtactacccgtgacgtacgttacgttcgtcgtcggtcctaccgacgtaccgtacggtaacgggtactacggtactaacggttaccgttaacggtttacgtaacgtttacgtaccggtaacgggttaggtaacccggtaccggtaacggaaccggtaacgggaaccggggaccgggtacggtaccgttaaacgtttaaccgtttaaccgtttaccgttaacggtaaaccctaaaacgggttaaggtaaccgggtaacgtaaacgggtttacggtaacgggttaacgttaccggttaggggtttaggggttacccgggtttacggggaccggggtaacgggtaaacccggtacgggtacgtttacccgggtaacccggttaccggttaccgggtaacgtaaccccgggtacccgtaacgggtacccgttcccccggtaccccggtttacccgg

SEQ ID NO: 201418 - DNA, 753 bp, Homo sapiens
  misc_feature: GYAE6OF01ATS5B.21.46.E02.1.454.CMB.1.raw
  modified_base (516)..(516): a, c, t, g, unknown or other
  misc_feature (516)..(516): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctctgcacagctctggacggcctcctatgagctacgacacacgccctacccgtcggtgtcaggtccgtaccccgaggacgacggaccggaccgaggtactccaccgtgtcctcgtcgacgacgacgtcggactacgaacctaaaaggaattacgttacgttacttaacgttaccggaaaccgtaacgaacggaacggaccgaacggaccggaccggtccccgttaggttacggttaaggtagtaacgttaattaaacgtaaacgtacctacggtacggaacggaccggtaccagaacgtacgtacccgtccgtaggacgtacgttcttctacgtaccgcctacgacgtccgaggacgacgacgaacgtgtaccgttagtactacgtanacgtacggtacgaccgtacgagacgagggtacggacgtacggtacgttactaacggttacttacgtacgtaaacgtaacgtgtaaacgtacgtacgttaggacgttacgttaggtcgggtttacggggacggtcgggtaacggggaacgtaccggtacggttcggtaacgggtacccgtacgggttaaccacccgggtacgtaacccggagtccccgtcccggttcccgtacccggg

SEQ ID NO: 201419 - DNA, 614 bp, Homo sapiens
  misc_feature: GYAE6OF01CKOPR.21.46.E02.1.454.CMB.1.raw
  modified_base (364)..(364): a, c, t, g, unknown or other
  misc_feature (364)..(364): n is a, c, g, or t
tcagtcgtcgctcgcacgaccggtgctcgatttagactcatctacagggaaagggggtgggtccaggaggcagaactctgggtgtctcaccatggcctggatccctctacttctcaccctcctcactctctgcacaggctctgaggcctcctatgagctgacacagcccaccctcggtgtcagtcgtcccccaggacagacggccaggatcacctgctctgcagatggactgaccaaaagaatatgtactttattacggtaaccaaacaaggaacgccgaacggcccgacggtccccttgttcgttaagtgaattaataataaaagacaacgtagagacggtaccctacgagacgactacccgngacgcgtattcgtacgtcggtcctccgagctacggagggacaggcacgtcgtacgttacgaactacgtacgaggtagaacgtccgaaggacgaaggagggaacgacggtactacgtaacgttattaacctagtacaaacgtagtacgaacgtagtaaggtacgtactacgtagttgggtcgtcgggacggacgggtaccaggcgtacggaccgtgtacgtaccgacgaccgacggtcctcccgtaccccg

SEQ ID NO: 201420 - DNA, 791 bp, Homo sapiens
  misc_feature: GYAE6OF01BNV5R.21.46.E02.1.454.CMB.1.raw
  modified_base (245)..(245): a, c, t, g, unknown or other
  misc_feature (245)..(245): n is a, c, g, or t
  modified_base (353)..(353): a, c, t, g, unknown or other
  misc_feature (353)..(353): n is a, c, g, or t
tcagtcgtcgctcgcacgaccggtgctcgatttagactcatctacaggggaaagggggtgggtccaggaggcagaactctgggtgtctcaccatggcctggatccctctacttcctccccctcctcactctctgcacaggctctgacggcctcctatgagtctgacacacgccctacccgtcggtcgtcaggtccgtaccccgaaggaccacgggaccggccaagggtctaccgacctgcttcgngacgagagtcggactaggaaccaaagtaatagtacgtacgtttaagttacggtaaccaacgaaggtaacgccgacggacccgaccggtccccttaggttgtttaaggngtaaagttataaacttaaaggacctagtaggaccggaacggaccctagaaggacgtaccgtaccgtaggacggtctacgtttcgacggtcaccgtcgaacgtcgtcgaacgggcacgtacgtagtcggtaacgttacgtacgtaacgttagaacggtacgtaacgacggaagggccgtaaagggacgggtaaccgagggttaccttaacggtaaacgttgtttaaacccgtacggtaaacaacgggttaagaacggtaacggtaagtacgggtaacgttacggtagttacgggttgggtacggggttaccgggaaaggtagggtaaccccgtaaggtcgggtttaccggacccggttaaccggtaggggttacccccaaacccggttcccgggaaacccgggttcccccgtaaaccccgggttcccggttaaacccgg

SEQ ID NO: 201421 - DNA, 680 bp, Homo sapiens
  misc_feature: GYAE6OF01EJ7DZ.21.46.E02.1.454.CMB.1.raw
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
  modified_base (371)..(371): a, c, t, g, unknown or other
  misc_feature (371)..(371): n is a, c, g, or t
  modified_base (413)..(413): a, c, t, g, unknown or other
  misc_feature (413)..(413): n is a, c, g, or t
  modified_base (433)..(433): a, c, t, g, unknown or other
  misc_feature (433)..(433): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggcctctggacggcctcctatgagctgacacacgcccacccgtcggtgtcacgttcgtccccaggacacggaccggccaggactccaccgtgctcgtgcagtgtacggacctacgaaccaaaagtaattacgtgtactttagttacggtaaccaacgaagacgccgaggccacggccctgtagtagntatataagaagacacgtgaggaccgtccctanaacggacactaccgngacgtcgttacttcgtcgtcgctccacgctacggaggtaccnggtactagtaccacggttanacttactacgtagtaggaacgtccgaaggacgaggacgaacgggcgtaccgtagtaaccttatttacgtacgtaaccaaagtaggtaaccggaagtacgggttaagtacggttactaggttagggtttcgggtacgggttaccgggaccgggtaacgggacccgtaacggtaccgttacgggtaccctaccggttacgaccggtaccgtaccggaaccggttcccgtacccggtcccccggttacgg

SEQ ID NO: 201422 - DNA, 598 bp, Homo sapiens
  misc_feature: GYAE6OF01BRAF0.21.46.E02.1.454.CMB.1.raw
  modified_base (347)..(347): a, c, t, g, unknown or other
  misc_feature (347)..(347): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggaggccctcctatgagctgacacagcccacccgtggtgtcagtcgtccccaggacaggaccggccaggactccacctgctctgcagatggactgacaaaagaatatgtattattacggtaaccaaacgaggaacgccgacggccgacggtccccctggtgttacgtagtatagtaataaagacacgtgagcggaccctagaganactcctagagcgtattctgtcggctccgagccgtacgacggacagctacgtcctagttctactatcgagtacgagccgtaggacaggacggagagtcgtagtacttagtactagtaaccaaagagtagaaacgtaggaacggttagttacgtagtaggttagggttcgtacggggcggaaacggacgacggtacgtacggtcccgtacggtacgaccgacgtaccgaccggcctccccgtcccgtacccgg

SEQ ID NO: 201423 - DNA, 786 bp, Homo sapiens
  misc_feature: GYAE6OF01E4R4M.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccacctgctctgcagatggactgaccaaagtaaatatgtcttagttacggtaaccaacgagaacgccgaggccacggcccctgtgttagtgatataataaagacactgagacggccctagagacgactcccgtagacgacgtacttccgtcgtcggcctccgacgtccgtacggaagggaccacggtaccgtaggtaccgtacggtttacgaacgtacgtacgtaggtacggtaaccggtacccgacgggtacgaacggggaacgggaccgggtaggtaccgttaacgtaacccgtttaagtttaaccgtacggttaaaccgaaaacgtaagggtaaacggaacggtaacgggttaaacggtaaccgggtttaccttacggttaacggggttttacgggggttacggggttacccgggggtaaccggggtaacggggtaaacccggtaacgggtacccgttaaacccggggtaccccggtttacccgggtaaaccggggttaccccgtaaacccgggacccccgggttaaaccggggtcccccgttacccccgggtccccccggtttaacccgggg

SEQ ID NO: 201424 - DNA, 820 bp, Homo sapiens
  misc_feature: GYAE6OF01BVK9H.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctgcagatcggactgaccaaaagaaatatgtactttagttacggtaacccaaacgaagaacgaccgacggccaacgggtccccctaggttcgttagtaggataataataaagaacacgttaggagacggtccctacgaagaacgtactccccgtagacgcgtatttcctacgtacgggccttccgaacgtcctaccggaacggggtacacgtaccgtaggttaccctacgggtttacgtacttaacgttcgtaaggttacggtaaacgtcccgaaggtacgaaagggacgggtaaccggtagggtaccgtaggtaacccgtttaagtttaccgttaaggtaacccgtaaaacggtaaggttaacgaaccggttaaaggggtttaacggtaaacggggtttaacccttacggttaacgggtttttaacgggggtacggggtttacccggggtacgggggtaaaccggggttaacccggaaacgggtttacccggacccgggttaaccccgggttaccccggtttaaacggggttacccgaaacccgggtaacccccggtaaagggttcccccggttccccgtaccccccggggtttaccccggg

SEQ ID NO: 201425 - DNA, 668 bp, Homo sapiens
  misc_feature: GYAE6OF01B3GKQ.21.46.E02.1.454.CMB.1.raw
  modified_base (230)..(230): a, c, t, g, unknown or other
  misc_feature (230)..(230): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (553)..(553): a, c, t, g, unknown or other
  misc_feature (553)..(553): n is a, c, g, or t
  modified_base (655)..(655): a, c, t, g, unknown or other
  misc_feature (655)..(655): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacagctctgagcctctatgagctgacacagcccaccgtgtgtcagtcgtccccagacagacgcagatcactgctctgcagatgactgacaaagtaatntacgtcttagttacgtaaccaacgagaagccgagaccgtacggtaccccttaggtcgttagtacgtataataagtaaaacgactacgtaggacggacggcccttacgagtacgtactccgtagtacgacgtacttcgtcgtcggtcctaccgacgtcctacggtaacggacacgtctaacgtctacggttntaacgttntacgtagtacggtaacgtaccggaagtcgaaggacgggacgtacggtccgtaagtacctttaagttaccgtaagttaaccaaacgttacgtaacgtaacggtaggttaacgaacggttttaacncggtttaaggttggggttaccggttcggagggttaacgggaaccgtacggtacgacccggttaccgtacgaacgtcgtaacccgacggtaccgccgttcccncccgggttacccg

SEQ ID NO: 201426 - DNA, 653 bp, Homo sapiens
  misc_feature: GYAE6OF01DTS2E.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatcctctacttctccccctcctcactctctgcacaggctctgaggcctcctatgagctgacacagccaccctcggtgtcagtcgtccccaggacagacggccaggactcacctgctctgcagatggactgaccaaagaaatntgctttattaggtaaccaacagaagccaggccaggcccctgtgttagtgatataataaagacactaggagacggcccctagagacgtactacccgtgagcgtatttacctcgtacggcctccacgcctcggaacgggtacaacgcacggttaccgtaacgtttacgacttactacgaaggttacgtaacgtaccgtagggaacaagggaacgggtaccgacggtctagtaaccttagtttaactggtaacaagtacaaggtaacgagtacggttaagacggttactacgtaggtttcgggtacgggttacgggacgggtaacgggaaccctaaggcgttacggtaccccgggttacgtaaccgggtactaacccggacccgtaaccgggtccgttcccggtaccccccggg

SEQ ID NO: 201427 - DNA, 559 bp, Homo sapiens
  misc_feature: GYAE6OF01CE561.21.46.E02.1.454.CMB.1.raw
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctaacacagccaccctcgggtgtcagtcgtccccaggacaggacggccaggatcacctgctctgcagatggactgaccaaaagaaatatgcttattggtaccaaacagaagccaggccaggcccctgtgttagtgatataataaagacactgagaggccctacgagagaactccctgagcgattctntggcctccagctcagggacagcagtcacggttgactatcagtagagtccaggcaaggaggacgagntgactatacngtacaaanagtanacagtacgagtactntagttgggngtttcgggcggtagggaacctaggacgttcggacccggttccttaagggtccaaacggtccccgaaaggcccgttaccggcccccccgttcggggttaaccc

SEQ ID NO: 201428 - DNA, 732 bp, Homo sapiens
  misc_feature: GYAE6OF01CZN96.21.46.E02.1.454.CMB.1.raw
  modified_base (596)..(596): a, c, t, g, unknown or other
  misc_feature (596)..(596): n is a, c, g, or t
  modified_base (650)..(650): a, c, t, g, unknown or other
  misc_feature (650)..(650): n is a, c, g, or t
  modified_base (656)..(656): a, c, t, g, unknown or other
  misc_feature (656)..(656): n is a, c, g, or t
  modified_base (678)..(678): a, c, t, g, unknown or other
  misc_feature (678)..(678): n is a, c, g, or t
  modified_base (694)..(694): a, c, t, g, unknown or other
  misc_feature (694)..(694): n is a, c, g, or t
  modified_base (703)..(703): a, c, t, g, unknown or other
  misc_feature (703)..(703): n is a, c, g, or t
  modified_base (716)..(716): a, c, t, g, unknown or other
  misc_feature (716)..(716): n is a, c, g, or t
tcagtcgtcgctcgcacgaccggtgctcgatttagactcatctacaggggaaagggggtgggtccaggaggcagaactctgggtgtctcaccatggcctggatccctctacttcctcccctctcactctctgcacgaggctacgtggacgcccttcctatggaagctacggacaacgacgaccctaacccgtggtcgtcgacggttccgaccccgaagggacctacggaccggaccgaaggtacctcccgtaccgtcgcttcgtggacgtaaggtacgtacggtacgtacggaaaccgtaaaaggtaattcggtagtacgtttaagtacggtaaaccaagaacggaccgaccgtacggccgtaaccggtccgttaggtagttaaggtataataaacgttaaacgtaaacggactaacggtacggaacggaccgtaccctaagacggtaactcgtaccgtaggacgtacgtttcgttacgtccgcggtaccttaccgaacgccggtacgaacggacgacgtacgtaagttacccgtaagtactaacgtgtaacgtaacggtacgtacgacggaaacgaggaacgggacggtaacggntagttacggaccttttagactaagacctaagaggtacgaagttacgagtacgtnttaggngggtttggacgtcggacggtanacgtacgcgtaacggnttaccgganacgtacccgacgngtcctcccgcgttacg

SEQ ID NO: 201429 - DNA, 855 bp, Homo sapiens
  misc_feature: GYAE6OF01DGV4H.21.46.E02.1.454.CMB.1.raw
tcagtcgtcgctcgcacgaccggtgctcgatttagactcatctacagggaaagggggtgggtccaggaggcagaactctgggtgtctcaccatggcctggactcctctacttcctcccctctcactctctgcacgaggctctggacgtccctactagtgagtctacgaccacgacgcccctacccgttgggtctacgacgttcccgaccccgaaggaccacgggaccggaccgaaggtacctacctaccgtcggtccttcgtacggaccgaaggtacgttacgggacctaccggaaaaccgtaaaaagtaaacttgtacgttacgttttaaggttaccggtaaaccaacgaacggaaacgaccgacggacccgtaccggtaccccgttggtttaggttaggtaagtaatttaacgttaaaacgtaaaacgaaccgtaacgtaagggaacggtacccggtaccccttaaggaacgtaacggtaacccgttaccccggaggtaacgtaccgtttaacgtttccgtacggttcccggtaccttaccggaacgtcccgtaacggaacgggacctacgacgtaacgtaccgttacggttacgtaacttacgtacggaagttacggtaaacgtccggaaggacggaaacggggtacggaacggaggtcctaacgtaactttaacgtacgtacgaaactaaacggaagtaacggaaagtagggttaacggtaacgttacgttacgttaggggttcgggtttacggaccggggtaccgggaaacggtaacgtaaggtcccggtaacggtacccggttacgtacggacgtacccggacgacgtccgtccccgtcccggtaccgg

SEQ ID NO: 201430 - DNA, 745 bp, Homo sapiens
  misc_feature: GYAE6OF01AVOR4.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaaggatcacctgctctgcagatggactgaccaaaagaatntgtacttagttacggaaccaacagaacgccgaggccacggcccctgtgttagtgtatataataaagacacgtagaacgacggccctagagacgactcccgtaggacgtcgtacttcctcgtacggtcctaccgacgtccgtacggaacgggtacacggtacgtaacggtacccgtaacgggtttacgaacgttacgttaccgtaggttaacggtaaacggtaccccgaaagggtacgaaacgggaacgggtaccggaacgggtaccgtaacgttaacctttaacgttaaccgtacgtaaacctaaaacgtagtaaacgaacgtaagggttaacgaacggttacctaggttaggttacggggttacgggttaccggggacggggtaaaccggggtaccgtaaacggtcccgtaaccgggtacccggttaccggtaacgggttaccgaaacccgggtaccccgtaaaccgggtccccgttccccgggtaccccccggttaccggg

SEQ ID NO: 201431 - DNA, 886 bp, Homo sapiens
  misc_feature: GYAE6OF01CG4UU.21.46.E02.1.454.CMB.1.raw
  modified_base (159)..(159): a, c, t, g, unknown or other
  misc_feature (159)..(159): n is a, c, g, or t
  modified_base (188)..(188): a, c, t, g, unknown or other
  misc_feature (188)..(188): n is a, c, g, or t
  modified_base (249)..(249): a, c, t, g, unknown or other
  misc_feature (249)..(249): n is a, c, g, or t
tcagtcgtcgctcgcacgaccggtgctcgatttagactcatctacagggaaagggggtgggtccaggaggcagaactcgtgggtgtctcaccatggcctggatccctctacttcctcccctcctcactctctgcacaggctctgacggcctcctatganctagaccacgacgacccacccgtcgggtntaccgtcggtccgtacccgaaggacgacgggacggaccgaggctacctacgtcgcgttcgngactaggacgtacggactaacgaaaccgaaaagtaaacttacgtacgttaatttacggttaacggaaaccaacgaaacggaaccgtaccggaaccggaccgtacccggtaccgttaggttaacggttaagttaggtaaacttaaacttaaaagtaaaacgtaacgtaacgtacggtaacggtaccgtaccgtaacgaaacggtacggttacctaccggagtaccggtacgttaccgtttaccggtcgtacgggtccaccggtaacggtccggaacgggaacggtcggaaaccgtcggtttaaccggtaaccggttacgtttaacggtaaaccgttacgtacgggtaccgttaacggggtaaaccggtaccggaacggggaacgtaaacggggaagggtaacgggtaacggtacggtaaacgtaacgttttaacgacggttaaacaaacggttaacggaagggttaacaacggttaacggtacgtaacggttaccgtaacgggttacgggttgggttaccgggaacggaacgggaacggtaaaccggcgtacccggggtttaaccgcgggtttaacccgagggttaacccgtacgggaaccccgttccgggaccttaacccccgggtccgtaacccgg

SEQ ID NO: 201432 - DNA, 786 bp, Homo sapiens
  misc_feature: GYAE6OF01BWNH4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctggaggcctcctatgagctgacacagcccacccgtcggtgtcagtcgtccccaggacaggacggccaggactccacctgctctgcagatggactgaaccaaaagaatagtgtactttagttacggtaacccaaacgaacggaaacgtacccgaacgggacccgaacccgggtcccccgttggttacggtttaaggtagtaattaaacgttaaacgtaaaaacggaaccgtaacgtaacgggtaacggtaacccgggtacccccgttacgaaacggtaacggtaacccttacccccggtaggaacggtccggttaactttccgttcggttaccgggtcccttaacccggtacgtcccgtaccggaacggggacctacggacctaacggtacccgttacggtttaacgaactttaacgtacggtaaggttacggtaacggttaccccgaagggaacgtaaggggaacgggacgggtacggtacgtaacgttaacctttacgttaaccgtacgtaaactaaacggtagtaacgaacgtaggttaagtagttactaggtaggttgggtcggtacgggacgggaacggtaccgaggtcgacggtcccgtacggtcgacgacgacccgagtcccgtcccgtcccctacgg

SEQ ID NO: 201433 - DNA, 830 bp, Homo sapiens
  misc_feature: GYAE6OF01ECE9J.21.46.E02.1.454.CMB.1.raw
tcagtcgtcgctcgcacgaccggtgctcgatttagactcatctacagggaaagggggtgggtccaggaggcagaactctgggtgtctcaccagtggcctggatccctctacttctcccctcctcactctctgcacaggctctgagcctctatgagctgacacagccaccctcggtgtcagtgtcccaggacagacggcaggatcacctgcgtctgcagtatcggactgccaaaagaatatgcttattggtaccaacagaacgccgaggccacggcccctgtgttagtgatatataaagacacgtgagacggccctacgagacgtactcccctagacgcgtacttccgtcgtcggccttacccgaggtccgtacggaagggtaccacggtacgtacggttacgtacggtttcgaacgtttaacgtaccggtaagggttaacggtaaaccgggttacccggtaaagggaacccgaaacggggtaaacggggtaccccgggtaaaggggttcccgttaacgggtaaaccgttttaccggtttaaccggtttaacggtaaacccgtaaaaacgggtggttttaaaccgaaacccggttaagggtttaaccgggaaaccggttttaaccgttaacccgttaaggggttttcgggggttaaccggggtttccgggtaacccgggggggtaaaccggtaaacccgggttaaaaccgggttccggttaaccccgggttaaccccggtttaacccgggttaacccgggaaccgtaaccccgggtaaccccgtaacggggtccccgtttacccccgggtacccccggttaacccccgggg

SEQ ID NO: 201434 - DNA, 704 bp, Homo sapiens
  misc_feature: GYAE6OF01DC3AM.21.46.E02.1.454.CMB.1.raw
  modified_base (626)..(626): a, c, t, g, unknown or other
  misc_feature (626)..(626): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctctgacgtcctctagtgagctgaccacgacgcccctacccgtcggtcgtacacggtccgtaccccgagggacacggacggaccgaggacttccaccgtgtccttagcgacgagtagtaccggactacgaactaaagtattagttgttactttacgttacggaaccagtaaggaacgcggtaacggccacggtcctaggttacggtagtagactaagtaactaacgacagtacggaacgccgtacctagagtacgtacctccgtagacgttcatttccgagtcgtaccgacacggtccaggtacggactcgaaccctggtacgtaacgttacgactaacgtagtaacggaacgtaggtacccgaagggtacggacggacggtaaccggcggttataaccggttaactttacgaaccgtaagaaccgtaagaacggtacgaagtaacgtaacggtacgttacgttggttagggtagggttaccgggngggtaaccgacggttaacgcggttacaaccggttccgtaggtaccggactacggacccggagtcccgtcgccgttccg

SEQ ID NO: 201435 - DNA, 664 bp, Homo sapiens
  misc_feature: GYAE6OF01EGKMS.21.46.E02.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccagggatcacctgctctgcagatggactgaccaaagaatntgtcttattggtaaccaacagaacgccaggccaggcccctgtgttagtgaatataataaagacactaggagacggccctagagaacgactccctagacggtcgtacttctacggtcggccttaccgacgtctcgaacggggacagaccgagttccgtaacggttcgaacttataccgtagtagtaacgttaccgaaggaccgtaaggaacggacggtaggtccgtagacttaacgttaacttacggtaaccaaagtaacggtaacgaaccgtaagggtaacgtaacggttacttaccgtaaggtttcggggtcgggttaccggggacggggaacgggaaccgaaggtccgttaccgggtccgttaccggtaggtacccgacggaccccgtaaagggccctccccgggtcccccgttacccgggg

SEQ ID NO: 201436 - DNA, 616 bp, Homo sapiens
  misc_feature: GYAE6OF01E44NP.21.46.E02.1.454.CMB.1.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttatggtaaccaacagaagccaggccacggccccctgtgttagtgatagtataaagacagtggagaggccctnagagctcccngagcgtattcctctggcctcagctcgaggacagcagtctacgttgactatcaggtagaagtcccgaggcgaggacggacggacggctacgacttacgtttacgtagttaccaaacgtagtaacggacgtaaggttaaggaacggttaccgttacgtacgggtttggggttaggttccgggaggggaaccgggtaaccccgaaagtccggtaccggtacccggtttacccgtaacgggttaccgaacggtaccccggaaacggcccgttcccggccccccggttaccggg

SEQ ID NO: 201437 - DNA, 765 bp, Homo sapiens
  misc_feature: GYAE6OF01AEOIT.21.46.E02.1.454.CMB.1.raw
tcagtcgtcgctcgcacgaccggtgctcgatttagactcatctacagggaaaggggggtggggtccaggaggcagaactctgggtgtctcaccatggcctggatcctctacttctcccctcctcactctctgcacaggctctgaggcctcctatgagctgacacagcccacccgtcggtgtcagtcgtcccaggacagccggccgaggactcacctcgctctcgcaggatacggactacgaaccgaaaagtaaactgttacgtactttagttaccggtaaccaaacgtaacgaacgaccgaacggccgaccggtccccgttggttaggttacggtagtaagttaacttaaacgtaaaacggacctacggtaggaaccggaaccgggtccccttaacgaaggtaccgtacctcccgttaggacgtacggttacttcgtaccgttaggcccgttaccgacggtacctaaccgggtaacggggaacctaggaccgtaacgttccggttaacgtttaaccggtaccttagtaaccgtaggtaacgggtaaccggttacggacgaacggaagggtaccgggaacgggtaacgtcgtaacggttaactattacgtacgggtaaacaacgtaagactaggtagaacgttaggttacgtagtacggttggggtcccggttaggacgggaaccgggaactacgtcggttacgttaccggaccgtagttacccggacggttacccgacggttccctaccccgggtccgttaccgg

SEQ ID NO: 201438 - DNA, 695 bp, Homo sapiens
  misc_feature: GYAE6OF01BOVH2.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggccctctatgagctgacacacgcccacccgtggtgtaccgagtccgtaccccgaggacgacggaccggccgaaggactacctaccgtggtccttcgcgacgtagaacgtcggaacctcgaaacctaaaagtaatagttacgtactttaagttaccggtaaaccaaacgaacggaacgaccgacggaccgaccggtccccgttggttaggttacgtagtaataagttaaacaaacgactagagacgacgtcccgtagaacggactaccgtctaggacgtacggtcttacgtcgtcgtctacgtcgcgtacggaacgtacgaggtcgttaacgtcgtaacttacgtactagacgtagtagacgacgacggtagaaggacgcggacggtactagtaacgtagttacgtagaaccgtaagacgtaatacggtaagtacggtagtacttacggtaggttacgggtcggtacggaggaccgtacggagtccgacgggtcccgtaagtaccgggtaccgacccgtacgggtacccgttccgcccggtcccgtaccg

SEQ ID NO: 201439 - DNA, 771 bp, Homo sapiens
  misc_feature: GYAE6OF01DZKCF.21.46.E02.1.454.CMB.1.raw
  modified_base (478)..(478): a, c, t, g, unknown or other
  misc_feature (478)..(478): n is a, c, g, or t
  modified_base (506)..(506): a, c, t, g, unknown or other
  misc_feature (506)..(506): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacgaggctctgacgcctcctatgagctgacacacgccacccgtcggtgtcagtcgtcccgaggacgagaccggaccagggactaccgtaccgtgtcctcgtcgacgaagacgttacggaccgtacgaaaccgaaaagtaaattacgtacgtactttaggtaacggtaaaccaaacggaagaaccgaccgacggacccgtacggtccccttaggttagttaaggtacgtaaagttagtaaaacgttaaagactaacgtaggaacggaccgtacccttagaacggtaactacgtaccgtaggacgtactacgttcgtcgtaggcctcgacggtacgtacgagggacncgacgtaacgtcgttaagtctaacggtnacgtaagggtaccgtaacgtacggacggtaaggaaggtaccggggactacggtcttaacgtaacgttattaacggtacctaaacgaaaccggtaggaacgttaacgggaaggttaaacccggtagttaaccggtacggttacggggttacgggttaccgggggtacgggtaaccggaacgggtaccggtaacggttaccggtaccgggtaaccgttccgggacgtaccgaccggacgtacggtccgtacccccgtcggtacccgg

SEQ ID NO: 201440 - DNA, 784 bp, Homo sapiens
  misc_feature: GYAE6OF01EQPFH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacggcctctatgagctgacacacgcccacccgtcggtgtcagtcgtacccaggacaggacggccaggactccacctgctcgtgacagtatggacctacgaaccgaaaagtaattagtcgtactttagtacggtaaccaacgaacgacgaccgacgccgaccggtccctggtacgttagtagtaacttaataacgtaaacgacctaggtacgaacggtaccggtaccgtacgaagtacgtaccctaccggtaggacggtcgttacgttccgttaccggtcggtaccctaccgtacggtaccggtaacggaacgggaccgacgtaccgtacggtacgttaacggttataaccgttacgtacggttaacgtaacgggtaaccgtaccggaaggtacggaacgggtaacgggaccgggtacgggtactaccggtttaacttaaccgtttaacggtaaccgtaaccgtaaacggtaaggtaacccggtaagtaacgggtaacggttaacggttacgttacgggttaacgggtttcggggtaacgggttaccggggaacgggaaccggtaccgtacgtaccgggttactacccggtaccggtagacccgtacggaccgaaccgtcccgtaccggtcccgttaccgg

SEQ ID NO: 201441 - DNA, 723 bp, Homo sapiens
  misc_feature: GYAE6OF01AE801.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacacgcccacccgtcggtgtcagtcgtccccaggacacggaccggcgaggactccaccgtgctctgcagagtggactcgaaccaaaagtaaatatgtactttagtttacggtaaccaaacgagaacgtaccgacgggacccacgggtcccccttggttacggtttaagtacgtaatttaacgtaaagtaaaacgaactaacgttaggaaggaccggaccctagaacgaacgtacctcccgtagacgtacgtactttccgtcgtcggcctaccgacgtccgtacggacgggactacggacgtacgtaccgtacgttacgtaactagtacgtagtacgtaacgtcccgaaggtacgaggaacgggacgtacggtactacggtacttacgtttacgacgtaacgaacgtaggaacgacgtaagtacgtaagttacgtacgtaaggttcggggtaggtccggggacgggtaacggaaccgtaacggtcggttaacccggcccgttaccgggtaacgtccgaacccggtaccggaccggtcccgtacccggtccccgttacccgg

SEQ ID NO: 201442 - DNA, 713 bp, Homo sapiens
  misc_feature: GYAE6OF01EI7LL.21.46.E02.1.454.CMB.1.raw
  modified_base (384)..(384): a, c, t, g, unknown or other
  misc_feature (384)..(384): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgccacccgtcggtgtcagtcgtaccccgaggacacggacggccaggatccacctgctctgcagagtggcctagaaccgaaagaatatagtacgttattaggtaaccaaacgacgaacgcccagggccctaacggtcccccttaggttaggttaagtacggtataagtaactaaacggactaacgtaggaccgtacggaccctagaacgtccgtaacgntaccgtacgacgttcgtactcgtcgtccgtactacgtcacggacgacggacgacgtacgacgtttacgtacgttacgtacgtaacgtacggtaacgggtaccgtaacggtaccgacggacggaaacggacgggaacgtacggtaacgtacgttaaccttaagtttacgtaaacgtaacgtaagtaacggtaaggtaacgtaagggtacgttaacggttacgttagggtaggttacgggtacggtacgggaacgggtacggaccgtacggtacggtccggttaccgacgtacggtaccgaccggacccgtacggtccccgtcccgtcccg

SEQ ID NO: 201443 - DNA, 536 bp, Homo sapiens
  misc_feature: GYAE6OF01ALXSU.21.46.E02.1.454.CMB.1.raw
  modified_base (310)..(310): a, c, t, g, unknown or other
  misc_feature (310)..(310): n is a, c, g, or t
  modified_base (427)..(427): a, c, t, g, unknown or other
  misc_feature (427)..(427): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctnagagactccctgagcgattctctggctcagctcgagggacagcagtcacgttgactatcagtgaacgtcaggcagacggacgaggctaggactagtacctgtaccaacagtaacganagtagaggtactcgtagttgggtggttcggacgggtagggacccgtaaggcgtggacccgttccgtaggtccgacggtacccgaagggtcctccgccccccgttaccgg

SEQ ID NO: 201444 - DNA, 805 bp, Homo sapiens
  misc_feature: GYAE6OF01A57CJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatcactgctctgacagatggactgaccaaaagaatatgtacttagttacggtaccaaacaagaacgccgaaggcccgaacggtcccccgttggttacggtttaaggtacgtaattaattaaataaaacggaacctaacgtaggaaggacggacccctacgaaggaacgaccgttaccccgtaggacgtaccggtaactttccgtacgtcgggccctaccacggtcctacggaacggggtaacacgtacgtaacgttccgtaacgtttacggtaacttacgtacgtagggtaacggtaaccggtaccggaacgggacgaaacgggaacgggtaaccgggaacgggtaccgtaacggttaacccgtttaaagtttaacccgttacggttaaaccaaacggttaacggtaaacggtaacgtaagggttaaacggttaacggttaaccgttaacggttacgggtttcgggggttacgggttaccgggggacggggtaacggggtaacccgaacgggtcccgttacgggtaccccgttaacggttacggaccgtaaccggaccccggaaacggtcccgtccccggtacccccggttacccgg

SEQ ID NO: 201445 - DNA, 710 bp, Homo sapiens
  misc_feature: GYAE6OF01B32GX.21.46.E02.1.454.CMB.1.raw
  modified_base (239)..(239): a, c, t, g, unknown or other
  misc_feature (239)..(239): n is a, c, g, or t
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatntgcttattggtaccaanagaagccaaggccaggcccctgtgttagnagtataataaagacactgagaggccctacaagacgtactcccgtaggacgcgtactttcgtcgttgggccttacccgaaggtccgtaccgaagggggtaccacggaccgtaacggttaccgtacggtttacgtaacgttacgttacgtaacggtaggtaaacgtaccgtaacggacgaaggaacggaacggaacgggacgttacgtaacgttaacgtttaacgttacgttaaccgtaaaacgtaacggttaagaacgtcggtaaaaaaaaggtcggttaaacgttacgtagtttagggtacgggttacgggtaccgggtaacgggtaccgtaaacggtaccgttacgggtaacccggttaccgttaacggtaccgtaaccggtacccggtaacgggtacccgtaccggtcccccgttaccccggg

SEQ ID NO: 201446 - DNA, 720 bp, Homo sapiens
  misc_feature: GYAE6OF01BLJ35.21.46.E02.1.454.CMB.1.raw
  modified_base (267)..(267): a, c, t, g, unknown or other
  misc_feature (267)..(267): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacagcccaccctggtgtcagtcgtccccaggacagacggccaggatccacctgctctgcagatggactcgaccaaaagaaatatgtacttagttacggtaaccaanagaacgccgaggccgacggtccccgtgttacgttagtagtaattaactaaagtaaacgacctacgtaggaacgtacggtcccctagaaggtacgtaccttaccccgtaggtacggaccgttacgttccgtccggttcgggtaccctaccgaacggtccgtacggaacggggtaccacggtacgtaacgtaccgtaacggttacgtaacttacgtacgtaggtacggaacgtaccgaagggacgtaagggacggaacggtacggtacgttacgtaacttacgttacgtaacgtaaccgtaacgtagtaacgaacgtaggtaacggttacgttacgtacggttaggttacgggttaggtaccgggtacgggtaacggtacgtacgggtcctaacgggtacccttacggtacggtacgaccgtaacccggtaggtcccttcccggtcccgtaccgg

SEQ ID NO: 201447 - DNA, 822 bp, Homo sapiens
  misc_feature: GYAE6OF01BOTKN.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccaggacaggacggccaggactcacctgctctgcagagtggactcgaaccaaaagtaaatatgtactttaagttcggtaaccaacaagaacgacccgaggccacgggtcccctggtacgttaggagtaacttataagtaaacggactacgtaggaacgacggtaccctagaacggaagtaccttccccgtaggacgacgtactttcgtcgtacggtcctaccgaacggtccgttacggaacggggtaccaacggtccgtaacggttaccgttaaccggtttacggtaacctttaacgttacggtaacgggttacgggtaaaccgtacccgggaaaggggtacccgaaggggtaaaccgggaacgggtaacgggtacttacgggttaaaccttaaacgtttacgttacgtaaaccgaaaacggttaggtaacggtaaccggtaaagggttacggttaacgggtttaactacgggttaggtttacggggggttacggttaaccggggacggggaaaccggggtaaacccgtaggtacccgttaacggggttaaccccgttacccggtaagggtaaccccgtacccggtaacccggtaacgggccccgttccccggttcccccgggttaccccgg

SEQ ID NO: 201448 - DNA, 730 bp, Homo sapiens
  misc_feature: GYAE6OF01AKZOW.21.46.E02.1.454.CMB.1.raw
  modified_base (280)..(280): a, c, t, g, unknown or other
  misc_feature (280)..(280): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctagacacacgcccacccgtcggtgtcagtcgtccccaggacaggaccggccaggactcacctgctcgtgcagagtcggactcgaccaaaagtaatagtcgtactttaagttacggtaaccaanacggaacgaccgacggacccgacggtccccgttggttagtttaacgtagtaacttaagtaaacgtaaaacgacgtaacgttagggaacggtacccggtccccttaaggaacggtaaccgtaaccgttccccgttaaggacggttaccgtacgttccgttacgtcggaccctaccgacgtccgtacggacgggaccaggaccgtacgtaccgtacggtttagaccgttagacgtacggtacggaacgtacccgaggacgaaggaacgggtacggaaggtccgtaagtacgttacttacgtacgaactaaacgtggtaacgaccgtaagtaggtacgttacgtcggttaggttgggttacggtcgggtacggacggtaccgtacggtcgacggtacccgtacgtacggaccgtacggacccgtaacggtcccgtacccggcccggttacccg

SEQ ID NO: 201449 - DNA, 759 bp, Homo sapiens
  misc_feature: GYAE6OF01C0SZZ.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctcccctcctcactctctgcacaggctctgacggcctcctatgagctgacacacgcccaccgtcggtgtcagtcgtcccaggacagacggaccaggactccactgctctgcgagatggactcgaaccaaaagtaatgtagtactttagtacggtaacaacgagaacgcgacgtaccacggtccttggtagtagtagattaagtaataacgacgactaggaacgtaccgcctacgaagaacgtccgtaccgtagacgcgttactttccgtcggttacgcctaccgagtaccggtaggaacgggtaccacggtaacggttacgtacccgttaagttacggaacccttaggtaccgttaacgggttaaccgaacgggttacccggaaagggacggtaaacgggaaccgggacggtaacggttaccgttaacgtaaccgtttaaacgttacgttaaccgtaaaccgtaaacggtacgtaaaaccggtaggtaaacgggttacggtaaacgttaccgtttagggttacggggtttggtttaacggggtacgggacgggttaaccgggaactacgggtaacttaccgggtaccgtacggttacggaccgtacccgggaccttacgggccctccccggtaccgttacccggg

SEQ ID NO: 201450 - DNA, 706 bp, Homo sapiens
  misc_feature: GYAE6OF01A73I7.21.46.E02.1.454.CMB.1.raw
  modified_base (219)..(219): a, c, t, g, unknown or other
  misc_feature (219)..(219): n is a, c, g, or t
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacagcccaccctcggtgtcagtcgtccccaggacagacggccaggactcacctgctcngcagatggactgacaaagaatactgtacttatcggtaaccaacagaacgccgaggccacggtcccctggttacgttagtgaagtataataaagacacgtagagtacggcccctagaggacgtaccgtcccgtaggacgcgtactttccgtacgtcggtactaccgacgtacctacggaagggaccaggtccgtacggtacctacggttacgaccgttanccggttaagacggtaaacgtcggaaggtacgaagggacggaacggtaggtctaacggtacttaactttacgtagttaaaccgaaacgtaggtaacgtaccggaagggttaacggtaacggttactcggtaagggtttggggttaccggtacggggtaaccgggtaacggggtaccgaaaggttccggtaacgggttaccccgtcgggtaaacgccgtaaacccgggtaccgaaccgggttccgttaccccggtcccccggttaaccgg

SEQ ID NO: 201451 - DNA, 830 bp, Homo sapiens
  misc_feature: GYAE6OF01B1MCO.21.46.E02.1.454.CMB.1.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacacgccacccgtcggtgtcagtcgtcccgaggacagacggccagactccactgctcncgacgagagtggactacgaaccaaaagtaaatntacgtactttagttacgaacctaaagaacgaacgccgaacggcccgacggtcccctggttacgttaaggtagtaataattaaagtaaaacgacgtaacgttaggacggacggtccctagaacggtacgtaccgtcccgtagacgtaccgtacgtttccgtcgttcggtaccctacgtacggtaccgtaccggaacgggacgtacggtacgtaaccggttacggttaaccgtttacgtaacctttaaggtaccgttaagggttaaccgtaaacccggttacccggaaagggtaccgaaacgggggaaccggggtaaccgggacggttaaccgttaagtttaacccgtttaacgttaaaccgttacgggtaaaaccaagggttaacgtaaacggtaaccgtaagggtaaggttaaacggttccgttaaggtttcggggtttacgggtcggggtaaccggggcgggtaaaaccgggaccgtacgggtaccgtaccgggttacccggtacgggttaaccggacggttaacccggacccggtaaaccggtcccggttaccccgtcccccggtttacccggg

SEQ ID NO: 201452 - DNA, 793 bp, Homo sapiens
  misc_feature: GYAE6OF01DWLEA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgacagatcggactacgaaccaaaagaaattatagtactttaagttacggtaaccaaacgaagaaacgaccgacggaccgaacggtccccttggttacgttaaggtagaatttaagtaaacgtaaaacgaacgtaaccgttaggaacggtacggacccctagaacgagtaccgtaccccgtaggacggtaccgttaacgtttccgtacgttacggcccttaccgtaacggtccgttaccgaacggggaacctacggacgtacgttacgtaccgttagtaacctacgttacgtaacggtaggtaaccgttaaccgaggtacgaggaacgggtaacgacggtactacgtaactttaacttacgtaagttaaccaaaacggttagaaacggtaacgtaaggtaacggtaacggttaaccgtaggttaacgggttcgggttacgggttaccggggacgggtaaacggggaaccgtaacgggtacccgtaacgggttaaccccgtaccggttaaacgggtaccgtaacccggtaacccggtaaccgggtcccgttacccccggtcccccggttaacccgg

SEQ ID NO: 201453 - DNA, 731 bp, Homo sapiens
  misc_feature: GYAE6OF01EW16I.21.46.E02.1.454.CMB.1.raw
  modified_base (643)..(643): a, c, t, g, unknown or other
  misc_feature (643)..(643): n is a, c, g, or t
  modified_base (672)..(672): a, c, t, g, unknown or other
  misc_feature (672)..(672): n is a, c, g, or t
tcagtcgtcgctcgcacgaccggtgctcgattttagactcatctacagggaaagggggtggtccaggaggcgagaactctgggtgtcgtcaccagtgggccctggatcctctacttcgtcccctcctcactcgtctgcactaggctctgaacggccttcgtatgacgctgacacacgccctaccctcggtctctagtcgtcccaggtactaggacggcctaaggactccaacctgcctcgtggcgaacgagttcggaacttgaaccgaaaagtaattcgtcgttactttattacgggtaaccaaacgaagaacgccgacggaccgtacggacccccttaggtcgtttacgttagtacttaacgttaagtaaacgtaccgtactaacggtaacggtacgggacccttacggaacgggtacgggtaccttaccccgtaggtaacgtcggtaacgtttccgtacggtacgggtccttaccggacggtaccgtacggtaacgggtaccacgtaccgtacgtaccgtacgttacgtacctaacgtcgaacggtacgtaaccgtcgaacggtacgaacggtacggacgagggtacttaacgtactttaacgtcttaacgtacaaacgtagtaacgtacgtagttaaggngttaactggtacgttggtacggttacggnggaacggtacgacgtacgtcgacgtcgtacggcacggtacagtcctacgtcccgttacg

SEQ ID NO: 201454 - DNA, 684 bp, Homo sapiens
  misc_feature: GYAE6OF01CZVZY.21.46.E02.1.454.CMB.1.raw
  modified_base (327)..(327): a, c, t, g, unknown or other
  misc_feature (327)..(327): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctcgtgaggcctcctatgagctgacacagccaccctcggtgtcagtcgtccccaggaccagacggccaggatccacctgctctgcagatggactgaccaaaagaatatgacttattggtaaccaacagaagccaggaccagcccctagtgttagtgtactataataagactactagagtacggcccctanagagactacccgtagacgacggtatttccgtcgtggtccttcaacggtctacgaacgggaccaaggccagttaccgacgttcgaacttataccgtaaggtagtaacggtaccgaggaccgaaagggacgggaccgtacgggtacgttacggaactttaacggtttaaccgtcgtttaaaccgaaacgtaacggtaacgtaaaccggtaagggttaacggtacggttaaccttacgttaggttacggggttacggttaccggggacgggtaacggaccgaaacggtccgtaacggtacccggttaccgtacggtaccgtacggaccccgtaacggtcctccggtccccgttacccggg

SEQ ID NO: 201455 - DNA, 780 bp, Homo sapiens
  misc_feature: GYAE6OF01ED783.21.46.E02.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggtcctctatgagctgacacacgcccacccgttggtgtcgagtccgtaccccgaggacacggaccggacgtaggactccaccgtggtccttcgngacgagtagtcggaacctacgaaccgaaaagtaacttacgtaggttactttaagtttaccggaaaacccaacggtaacgaacgaccgaaccggacccgtaaccggggtccccttaggttacggttaggtagtaatagttaaacgtaaacgactaaccgtaggacgtaccggcctacgaacggtagtacctcgtacgacgtcgtaacgtttcgtccggtagccctaccgtgaccgttaggaacggtaacacgtacgtaacgttacccgttaaggttactaacgttagtacgtaacggttacgaacggtacggaaccggtaaggaacggtaccgggacgtacgtagtaaccggtactttaacgttaacgttaacgaaccgtaaagacggtaaccgaaggttaacgggtaagtaaacggtttctacggttagtttaggggtacggtacgggtaccgggaacggtacgaacggtcgtaccggtaacccgtcgtaacggaccgtacccggacgtaaaccggtccgacccccgtcccggtttacccg

SEQ ID NO: 201456 - DNA, 906 bp, Homo sapiens
  misc_feature: GYAE6OF01AQ554.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgacggccccttctagtgacgtctacgaccacgacgcccctaccgttcggtctacgtacgttcccgtacccgaggacgacggaccggaccgagtacctacctacgtctcttcgacgacgaagtaggtacggtacgtacgaaacctaaaagtaactacgttacgtttacgttaaggtttaaccgaaaccgaaacgtaacggaaccggacccggacggtacccggtaccggttcccgtttaggtttacggttaaggttaacgtaaatttaaaacgtaaacggttaaaacgaccgttaacggtaggaaccgggtacccgtccgtaaacgtacgtaaccggttaccccgttaaccggtaggaacccgtttaccggttaccttttcggtaccggtccggtaccttaaccgcggtccgtaaccgggaacgacgaaccggtgttaacccggtaccgtttaacgtacggttacctaacggttacggtaacgtacggttaaaccgtacggtaacgggacggaaagggtaaaccgggacggtaccggttaacgtaaccgttaaaccgtttaacggttaccttaaccggtaaactaaacggtaaacgtacggtaaacgttacgggtaacgttaacgttacgttacggtttaagggttcgggttaacgggtacgggtaccgggtaaccggtacggtaacccggttaccggtaccggttcgtacccggtaacgaccggtaccgacggttacccgcccggttacccgtcccggtacccgg

SEQ ID NO: 201457 - DNA, 891 bp, Homo sapiens
  misc_feature: GYAE6OF01DGMHB.21.46.E02.1.454.CMB.1.raw
  modified_base (810)..(810): a, c, t, g, unknown or other
  misc_feature (810)..(810): n is a, c, g, or t
tcagtcgtcgctcgcacgaccggtgctcgatttagactcatctacagggaaagggggtgggtccaggaggcagaactcgtgggtgtctcaccatggcctggactcctctacttcctccccctcctcacttctctgcacgaggctctgacggtcctcctatgacgctacgaccacacgccctacccgtcgggtcgtactacggtccgtacccgaaggaccgacggaccggaccgagggacctacctaaccgtgtcctacgtcgacgtaaggtacgtaccggaccgtacgaaaccgaaaagtaaacttacgttacgttattttaacggtaccggaaaccaacggaaacgtaaccggaccggtaaccgggacccggaccggtaccccgttaggtttacggttaacggtaagtaacgttaacgtaaaagtaaacgtaacgtaacggtaggtaaccgggaacccggtccaaacggtaaggtaccggtacctaccggtacgtaacgtaccggtttactttaccgtaccgttaccggtaccctaccggtaaccgtccggaacgggtaacggactacggaaccgtacgttaacggttacgttaacgtacgttacgtacggtaaggtaacgtaacggaccgggtaacgacgggtaacggtaccgggaacggtacggttaccgttaacgtaacttttaccggttaacttaaccggaaacgttacggaacggtaaacgttaacgggtaagtaacggttacgttaagttaccgggtttagggttacggggttaacgtaccgggggaccggaaggtaacccgngttaccccgggtacgttaccccgtacggtacggacccgtcccgggaacgttaccggcccggttaccccgccccgggttccg

SEQ ID NO: 201458 - DNA, 709 bp, Homo sapiens
  misc_feature: GYAE6OF01B1QMM.21.46.E02.1.454.CMB.1.raw
  modified_base (547)..(547): a, c, t, g, unknown or other
  misc_feature (547)..(547): n is a, c, g, or t
  modified_base (584)..(584): a, c, t, g, unknown or other
  misc_feature (584)..(584): n is a, c, g, or t
tcagtcgtcgctcgcacgaccggtgctcgatttagactcatctacagggaaagggggtgggtccaggaggcagaactctgggtgtctcaccatcggcctggactcctctacttcctcccctcctcactctctgcacaggctctgacggcctctatgagctgacactacgccctacccgtcggtgtcagttccgtaccccgaaggaccaggaccggccaggtactccacctgcctcgtgcaagtacgtcggactagaaccaaaagtaaatgtacgtctttaagttacggaaccaagagaacgaccgacggccaccggtacccgttggttcgttaacggtagtattaagtaagtaaacgtaaccgacgtaggaaccggtaccggacccttacggaaacgtacgtaacccgttcccgaaggtacgtaccggttacttcggtccgttggtaacccgttcgacgtccgtacgacgggaacacgtactaacggtctacggtactactagtaccgaagtacggtacgtacgacggacgtaaggacggtaaccgnggtaacgtagttacctaagttctaagtacctaaaggngtaaccgtagtaaggtacgtagtactaggttaggttagggtacggtcgggtaaccggaagtaccgacggtacgtacgtacgtacccggtagaccgtaccgacgtactcccgtccgcccgttacgg

SEQ ID NO: 201459 - DNA, 826 bp, Homo sapiens
  misc_feature: GYAE6OF01D8SLU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacgaggctctgacgcctctatgagtctgacacacgccctacccgttggtgtcgacgttccgtaccccgaggaccacggaccggccgaaggtactccaccgtgtcctcgtcgacagtacgtacggtacctacgaaaccgtaaaaaggtaattacgttacgttacgtttaagttaccgggtaaaccaaaacgaacggaaccggacccggaaccggtacccggtacccggtccccgtttaggttacggttacgttagaatttaaacgtaaacgtaaaacgtaccgtaacggtaggaaccggtaccggtaccctagaacggtacgtacccgtaccggtagacgtccgttacgttcgttcggtaccgtccctaccgtaccggtaccgtacggaacgggtaccgacggtaccgtaacggttaccgtacgggttacaacgttacgtaaccggaacggtttacgaaccgttaccggaacggtaacggtaacgggtaacgggaccggtaaccggttagtaacggtttaaccttaacggtttaacgtaacgtaaaccgtaagtaacgtaacgtaggtaaggttaacgtacggttatacggttagggttcggtacgggtacgggtaccggaaacgtaccggtacgtacgtaccggtaccgtacgtcgtaccgaccggtaccgaccgtccgtcccgtccgtaccg

SEQ ID NO: 201460 - DNA, 826 bp, Homo sapiens
  misc_feature: GYAE6OF01CADWQ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacacgcccacccgtcggtgtcagtcgtccccgaggacaggaccggccaggtactcacctgctcgtgcagatcggactcgaaccaaaagtaaatagtcgtactttaagttcggtaaccaaacgtagaaacggtacccgaacggaccgtaaaccggtcccccgttaggtttacggttaacggttagtaaactttaagttaaaacgttaaaacggaacctaaccggttaggaacgggaccgggaccccttacgaaacggtacggtaacttccccgtaaggacgtcgtaacgtttccgtcgtacggtacctaccggacgtccgtacggaagggaccaagtccgtaacgttacgtaacgttagaccttagacgtaggtagtaacgtccggaaggtacgaacgggacggtacggacggtaccttacggtaaactttacgtaacttacggtaaaccgtaaagtcggtaaacgtacgtaagggttaaccggttaaaggttacccttaagggttacggtttagggggtacggtttaccggggggaaccgggaaaccgggttaacccgtaaggggtacccgtaacccggggttccgttaacccgggttaacgggaaccccgaccgggtaacccggtaaccgggtccccgttcccgggttacccccgttaccggg

SEQ ID NO: 201461 - DNA, 885 bp, Homo sapiens
  misc_feature: GYAE6OF01DMDLQ.21.46.E02.1.454.CMB.1.raw
  modified_base (142)..(142): a, c, t, g, unknown or other
  misc_feature (142)..(142): n is a, c, g, or t
  modified_base (152)..(152): a, c, t, g, unknown or other
  misc_feature (152)..(152): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctcngagcctctangagctgacacagcccaccgtcggtgtacagtccgtacccgaggacacggaccgaccaaggactccaccgttgccttccgagacagagtcgaaccgtacgaaaccaaaagtaaactagtcgtactttaagttacggtaaaccaaacgaagaaccgaccgacggaccacggtccccgtaggttagtacgtgaaattaagtaaaacgtaaacgtaacgtacgtacggacgacggtaccctagaagtaacggtactaccgtagacggtcttacgttcgtacggtacggtccctacgtaggtaccgtacggaacgggtacccgaaggtaccgtaaacggttaccgttaacggttacgtaaaccgttaacggtacccgttaaagggtacggttaaaaccggtaccccggaacgggtaaaccggaaacggggttaccggaaacgggaccggttaacgttaaccggttaaactttaaaccggtttactaacggttaaacccgtaaaacgaaaccggttaaccgggaaaagtttaacgggtaacgggttaaccggttaacgtaacgggtttagggtttaccgggggttacgggttaaccgggaacgggggtaaaccgtaaacccgggtaacgtcccgggttaaaccggtaacccggttaaccgggttacgtaaaccccggtacgggtaaaaccccggtaccggttaccccgttacccccggggtcccctttaaaccccgggg

SEQ ID NO: 201462 - DNA, 681 bp, Homo sapiens
  misc_feature: GYAE6OF01A8UM7.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtcccccaggacagacggccaggatcacctgctctgcagatggactgaccaaagaatntgacttattggtaaccaagagaagccacggccacggcccctgtcgttagtgatataataagacagtgagacgccctacgagtagactccgagacgtcgtacttcctcgtcggtcctccgacgtctacgaggacgacgcgacgtaccgtacgttacgtaactactacgagtacggaacgtcgaggaccgtaaggacgggacgaggtcgtacgtaacgttaacttacgtacgtaaccgaaactaggtaacgtacgtaaggttaagggaaccgttacgttaacgttaggggtttcggggttacggttaccgggggaccgggtaaaccgggtaaccggtacggtaccggttacccggtaacccggtacccggtttaccgggacccgtaaccgggtacccccgaaaccgggttcccgtccccgggtaccccccgtttacccggg

SEQ ID NO: 201463 - DNA, 737 bp, Homo sapiens
  misc_feature: GYAE6OF01BHCV1.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccacccgtcggtgtcagtcgtccccaggacagaccggccaggatccacctgctctgcagatggactgaccaaagaaatntgtacttagttcggtaaccaacaagaacgccgacggacccgacggtcccccttggttacgtttaggtacgtaattaagtaaagttaaaacgacctaacgtaggaacggaccggtacccctagaacggaacgacctccccgttaggaacggtccgtaactttccgtcggtacgggtcccttaccgacggtcctacggaacggggacgacggtcgaacgttacctacggttacgtaacttacgtacgtaggtacggtaacgtcccggaaggcgaacgggacgggaacggacggtcgtaggtaaccttatttacgtacgtaaccaaaggtagtaagaacgtaaggtaaggtaacggttactacgttagggtttggggttcgggttaccggggacggggaaaccggggtaccgtaacgggtccggtacggtacccggttaccggtacggtaccgaccggtacccgacggtcccgttcccggcccccgttaccgg

SEQ ID NO: 201464 - DNA, 727 bp, Homo sapiens
  misc_feature: GYAE6OF01BW8TX.21.46.E02.1.454.CMB.1.raw
  modified_base (179)..(179): a, c, t, g, unknown or other
  misc_feature (179)..(179): n is a, c, g, or t
  modified_base (242)..(242): a, c, t, g, unknown or other
  misc_feature (242)..(242): n is a, c, g, or t
  modified_base (298)..(298): a, c, t, g, unknown or other
  misc_feature (298)..(298): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccacccgtcggtntcagtcgtcccaggacagcggccaggactcacctgctctgcagatggactgaccaaaagaatntgacttagtacggtaccaactagaacgccagaccacggccctgtgttagtgaatanaataagacacgtagagacggtccctagaacgtagtactaccctaggacgtacgtacttccgtacgtcggctacccgagtccgtacgaacggggaccagtccaacggtacctacggtttacgacttaacgtacgtaaggttacgaaacgggttcccgaagggaccgaagggaaacgggtaccgggaaggtaccgttacgtaaacgtttaccttaacgttacgtaaaccgtaaaacgtacggtaaacgtaaccgtaagggttaaaccgggaacgtttacgtacccggttaaaggttcgggggtttaaccggtttagggggaaccggttaaccgggggtaccgtaaaccggccgggttaacgttaccccgggttacgtacgggtaacgtacccgaacccggtaaggtcccgtaccccggtcccccgtacggg

SEQ ID NO: 201465 - DNA, 692 bp, Homo sapiens
  misc_feature: GYAE6OF01B57XD.21.46.E02.1.454.CMB.1.raw
  modified_base (306)..(306): a, c, t, g, unknown or other
  misc_feature (306)..(306): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagatggactgaccaaaagaaatatgtactttagttacggtaaccaacgaagaacgccgacggccacggtccccttggtgttagngtaataataataaacgacacgtggacgacggccctagaagacgtactcccgtagacgcgtattcctcgtcgcctccagccgtacggacggacacgtacgtacgtcgtacgtttacgacttagtacgaggtacgtaacggtccgaaggacgaagggacggacgaggtctagtacttacgttacgtacgtaaccgaaagtaggtaacgtaacgaggttaacggacggttaactcggttaggtttcgggggttacggttaccgggggacgggtaaacggggaccgtaacggttaccgtaccgggtacccggttaacccggttacgggtacccgtaaccggtacccccgggtaaagggttccccgtccccgggtcccccggtttacccgg

SEQ ID NO: 201466 - DNA, 872 bp, Homo sapiens
  misc_feature: GYAE6OF01EACPR.21.46.E02.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcanggctctggacgcctctatgacgctagacacacgccctacccgtcggtgtacaggtccgtacccgaggacgacggaccggccgaaaaggctaccaccgtgtaccttcgtgaccgaggtacgttacgggactacgaaaccgaaaaggtaaattcgtacgttactttaacgttacggtaaaccgaaacaacggaaccgaccggaaccgggtacccgtaaccgggtccccgttaggtttacggtttaacggtagttaaacgttaaacgttaaacgtaaaaacgtaaccgtacgttaacgggaacggtacccggtacccctaacgtaaacggtaacgttaccgtacccggtaggaccggttacgttaacgtttccgtacggtcggtaccctaacggtaaccgtacggttaccggaaacgggtaacgacggtaaaccggtacggttaaccgttaaccgggtttataaccgttacgttacggaacggttacggtaacgggtacccgaagggtaccgaagggtaacgggacgggtacgtccgttaacgtaacgttaactttacggtaacgtaacgaaacgttacggtaacgaacggttaagggtaacgtaacggttaccgttaggtaacgggtttcggggtaacgtttcggggggaaaccggtaacggtacggaacggttacggaccgtaccggttacgtaccggtacgaccgaccgtacggtcccgtcccggtaccccgtacgg

SEQ ID NO: 201467 - DNA, 693 bp, Homo sapiens
  misc_feature: GYAE6OF01CC0IO.21.46.E02.1.454.CMB.1.raw
  modified_base (185)..(185): a, c, t, g, unknown or other
  misc_feature (185)..(185): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
  modified_base (458)..(458): a, c, t, g, unknown or other
  misc_feature (458)..(458): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctctatgagtctgacacgacgccctacccgtcgggtntcaggtccgtaccccgaggacgacggacggccaggactcacctgcctntgcagntacggactaggaccaaagaaactntacgtatttagtacggaaccaacgagaacgccgaggtccgacggtcccgtgttacgtagtacgaattaataagtaaacgactacgtaggacgtaccgccctagacggacgtacgttccgnggaacgtccgtatttccgacggttcggcctcgacgtccgtagacgggtacagtccgtacggttacaccggtttanactaaggttctaacggacgtaaccggtcgacgggaccgaaagggtacggacggtaacggtcgtaacggtaactttacgttacgagaactaacggtaagaaccgtacgaggtactacggtacttaaggtcgggttagggtacggtaccggggacggttacggggacctacggtacgtaccggtacccggacggttacgacgtacggaaccccgtgtcccgcccgtccccggtaccg

SEQ ID NO: 201468 - DNA, 735 bp, Homo sapiens
  misc_feature: GYAE6OF01DWR9P.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgtacttattggtaaccaacgaagaacgccaggccacggcccctgtgttagtgtatataataaagacactagagacggccctacagacactccctaggacgacgtacttctacgtcggtcctaccgacgtccgtccggaacggggaccacggaccgtagtaccgtaacggtttacgaaccttaagtccgtaaggttaggaaaccggttcccgaacgggacgtaagggaacgggtaacggaacgggtaccgttagtaaccgtttaacgtttacgttacgtaacgaaacgtacggtaaacggaacggtaacggttaagggtacggttaaccgttacggttaggtttcgggggttacggtttaccgggggaccggggaacgggtaaacccgtaacgggtccgttacgggtacccccggttaccgttaacggggtacccgtaaccggtaccccggaaagggtcccttccccggggttccccccgttaaccccggg

SEQ ID NO: 201469 - DNA, 578 bp, Homo sapiens
  misc_feature: GYAE6OF01AVUQ1.21.46.E02.1.454.CMB.1.raw
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtcccccaggacagaccggccaggatcacctgctctgcggatggactgaccaaaagaatatgcttattggtaccaacagaagccaggccacggcccctgtgttagtgatatataaagacactagagaggccctcagagatcccngagcgtattctctggcctccngctcgaggacagcagtctacgtgactatctagtagaagtccaggcaggaggacgaggacgtgtactacgttctagtacaaacagtaacgaacaggtaacgtaacggttactacgttaggtttggggtagtttaccggggcgggtaagggtacccgaaggtccgttacggacccgttaccgtacggtacgacggacccgaacggccctcccgtccccccgtggtaccccg

SEQ ID NO: 201470 - DNA, 754 bp, Homo sapiens
  misc_feature: GYAE6OF01BXWTP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgcccacccgtcggtgtcagtcgtccccaggacacggacggccaggactcacctgctctgcagagtggacctgaccaaaagaatagtgtactttagttacggtaaccaaacgaagaacgaccgacggaccaacgggtccccttaggttagttaggtagtaataaagttaaacgtaaaacgaccgaacgttacggaacgacggtaccctacgaaaggacgtaccgtccctaggacgtaccgtacttccgtacgtcggtacctaccgacgtacgtacgaagggaccagtccgtaagtacgtacgtacgtactagtacgaaggtacgtaacggtacgaacggacgaacgggaaggaccgaggtacctagtaacgtttacttaacgtaagtaacaaaacgtaggtaacgaacgtaaggtaacgaacggtttactacggttagggttacgggttcggtaacgggtaccggggaaacgggtacccgtaagggtacccggttaccggtaaaccccggttacgggttaaccggtaccggtaaccccgggtaacccgtaaggggtcccccttacccgggtaccccccggtttacccgg

SEQ ID NO: 201471 - DNA, 587 bp, Homo sapiens
  misc_feature: GYAE6OF01EK0BN.21.46.E02.1.454.CMB.1.raw
  modified_base (240)..(240): a, c, t, g, unknown or other
  misc_feature (240)..(240): n is a, c, g, or t
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacggccaggatcactgctctgcagatggactgaccaaagaaatangtcttatcgaacaacagaagccacggcctacgccctgtagtagtcgatataataacgacacgtagagacggccctanagagtactccctaggacgcgtaacttctcgtcggtcctaccgtagaccttcgaacgggacctaggctacgtacgtaacttcggaactagtacgtaagtagaacgtacgaaggacgtaaggaggacggtaaggccgtaacgtacttatacgttactaacgaaacgtagtagaactaagtaacgaaggttactaggtagtcgggtagttcgggacgggtagacgtagtacgcgtacgtacgtagctacgcccaaggtctcccggcctaccgg

SEQ ID NO: 201472 - DNA, 767 bp, Homo sapiens
  misc_feature: GYAE6OF01CWUDG.21.46.E02.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctctatgagctgacacacgcccacccgtggtgtcagtccgtacccgaggacacggaccggcaaggctcaccgtgctcngcgagagtcgacctagaaccgaaaaagtaatgtagtacgtttaacgttacggtaaccaacgaacgaaacgaccgacggaccgaccgggtccccgttaggttaggttaacgtaggaaattaacgtaaataaacgaactacgtaggaaggacccgtccgtagaagtacgtacgtaccgtagaacgtcgtacttcgtcgtcggacctaccgcgtaccgtacggaacggtaaccacggtacgtaacgttccggttaaacgttacggtaacttacggtaaccggtaaggtaacccggtaagtacccggaaggaaccggaagggaaccgggaacgggtaacgtacgtaacgtaacttaaccggttacgtaagtaaacgaaacgtagtaacgaacggtaaggttaacgtaacgtacgttaggtacgggttcggtacggtacgggaacggggtaacggtaccgtaacgggttcccgtaacggtcccgttaacgggttccgaacggtaaccccggaccgtaacgggtccccgtacccgtccccggtaccg

SEQ ID NO: 201473 - DNA, 770 bp, Homo sapiens
  misc_feature: GYAE6OF01ATQH3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctggtgtcagtcgtcccaggacaggacggccaggactccacctgcctcgtcgacagtagtcggactacgaaccaaaagtaaattagtcgttactttaacgttacggtaacccaaacgaaggaacggtacccggaacgggacccgaccggtacccccgttagggtttacggtttaaggtacggtaaatttaaagttaaacgttaaaaacggaacctaaccggttagggaaccgggtaaccgggtacccccttaacggaacgggaaaccggttaaccgttccccggttaggaaccggtccggttaacttccgtccgtacgggtcccttaccgacgtccgtacggaacgggaccgagacctacggtaccgtacgttacgacttagtactaggtacgtaacggtaccgaaggacgaacgggaagggacgacggtaccgtagtaacttagttacgtacgtaacaacgtagtagaacgtagtaacggacgtactaggtaggttcgggtcggtacggacgggaacgggtaaccgtgtaccgtacggtcccgtacggtacgaccggtaccggtacccgtaaggcccttccgggtccccgtaccgg

SEQ ID NO: 201474 - DNA, 699 bp, Homo sapiens
  misc_feature: GYAE6OF01CEIET.21.46.E02.1.454.CMB.1.raw
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctggtgtcagtcgtccccaggacagacggccaggatccacctgctctgcagatggactgacaaagaatntgcttattgtaaccaanagaagccaggccacggcccgtgtgttagtgatataataaagacactgagtagccctacagagactcctgagcgtacttctacgtgacctcagctacgagggacacggactacggtacgtacggttaagtacgtaactcgtaaggttacggaaaccgtacggaaggtacggaagggacgggacgacgggtctacggtaactttaacgttacgtacgtaaacgaaaccgtaaggtaacgtaacgtaaggttaacggtacggttaacttacggttagggtttcggggttacgggttaccgggtaccgggggtaaaccgggtaaaccggtaacggtaccgggttaacccgggtaccccgggtttaacccggtaaccggggtacccgtaaacccggtaccccgggtaaacggtcccggttcccccgggtaccccccggttacccggg

SEQ ID NO: 201475 - DNA, 598 bp, Homo sapiens
  misc_feature: GYAE6OF01C3MOA.21.46.E02.1.454.CMB.1.raw
  modified_base (83)..(83): a, c, t, g, unknown or other
  misc_feature (83)..(83): n is a, c, g, or t
  modified_base (367)..(367): a, c, t, g, unknown or other
  misc_feature (367)..(367): n is a, c, g, or t
  modified_base (569)..(569): a, c, t, g, unknown or other
  misc_feature (569)..(569): n is a, c, g, or t
  modified_base (573)..(598): a, c, t, g, unknown or other
  misc_feature (573)..(598): n is a, c, g, or t
tcagtcgtcgctcgcacgaccggtgctcgatttagactcatctacagggaaaggggctggtctgggtctcacggattaaaacngacgggactaccacaaactacgcggactccgtgaagggccgttcaccatctccagagacaacgcaagagcacgctctatctgacaaatgacagtctgagagtcgaaggacagtggctgtaatattacgtgtgacgaggaaggaaaagggctgggaagttggtttaatttattccggtgggggacccaaacggggtaaccccttggggtaaacccttcccttcctacaccgtcccgtaccgaacccggaacgggccctagttccccgggttcccctttcccccgngggccctcccccgttgcccgtaccgaagggtcacccgaccctaccgggagaaccgccgaacgccgggaccccggtcccggttgggccgttacgtaccccggttgggtaaacccgaacggttacccttaaccccgttacccggaggacccggacgtacgtacgggacggccgggttacgacgggacgaacggcgtactagagnagcnnnnnnnnnnnnnnnnnnnnnnnnnn

SEQ ID NO: 201476 - DNA, 758 bp, Homo sapiens
  misc_feature: GYAE6OF01C5971.21.46.E02.1.454.CMB.1.raw
  modified_base (179)..(179): a, c, t, g, unknown or other
  misc_feature (179)..(179): n is a, c, g, or t
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtntcagtcgtccccaggacagaccggccaggatcacctgctctggcagatggactgaccaaaagaaatncgacttattggtaaccanagaacgccaggccaggcccctgtacgttagtgaatataagtaagacactagagacggccctacaggacgactaccccgtagacgtacgtacttttacgtccgttacgggcctttaccgacgaccttaccggaacggggacctaaggccctaaggtttccgaacggtttacggaaccgttacgttaccgtaggttacgtaaacggttcccgaagggacgaaacgggtaaggaaccgggaagggtacttacgggtaactttaacgtttaacgtacggtaacctaaacgtaacggtaacgaaacgttaacgggttaaggtaaccggtttaacgtttaacgttacggtttacggggttacggtttaacccgggggaccgggtaagggtaaccccgtaaagggttacccgttacgggtaaccccggttcggttaaacgggttccgtaaccgggtaaccccgaacgggtcccgtaacccggtcccccccggttaaccggg

SEQ ID NO: 201477 - DNA, 749 bp, Homo sapiens
  misc_feature: GYAE6OF01ELI6H.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactccacctgctctgcagatggactgaccaaagaatatgtacttagttcggaaccaacgagaacgccgaggtcacggccctgtgttagtgtatatataaagacacgtgacgacggccctagagacgtactcccgagacgtacgtacttcgtcgtcggtcctaccgacgtccgtacgaacggggtaaccacggtaccgtaacggttaccgtaacgggtttacgaacctttaacgtaccggtaaggtacggtaaaccggttacccggaagggaaccgaaacggggtaacgggaaccgggtaacgggtaccgttaacggttaaccgtttaacgtttaacgttaccggtaaaccgtaaaaccgtaaggttaaacggaaccgtaagggttaacgggtaaccggtttaacttacggttaacgggtttgggtaccgggttacggggaccgggtaacgggtaaccgtaacggtccgtaccggtaacccggttaccggtacggacccgtaccggacccgtaacggtcccgttacccggtcccccgttacgg

SEQ ID NO: 201478 - DNA, 780 bp, Homo sapiens
  misc_feature: GYAE6OF01CDJJD.21.46.E02.1.454.CMB.1.raw
  modified_base (169)..(169): a, c, t, g, unknown or other
  misc_feature (169)..(169): n is a, c, g, or t
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggtcctcctatgacgctacgacacncgccctacccgtggtgtcagtcgtccccgagacagaccgcaggntccactgctctgctagacgtacgactacgacaaagaatntgtactttagttacgtaacaacgagacgacgacggccgacggccttggtacgttacgtgtaatagtaataacgacgtagtaggacgacggtaccctagtacggacgtaccgtccgacgtacgtacgtttacgtttccgccggtcggcccttaccggactaccggacggaacggacccagggaccctaggtaaccgtaccggttacgaacgttcgtaacgtaagggttaacgaacgtacccggaagggacggaaacgggacggacgggtaccggtaccgtaacggttaacgtttaaccgttaacgttaaccggaaaacgtaacggtaacggtaagtaaaccggtaggttaaaacccgggtgtttaaccgtacggtttaggggttagggttccggggttaccgggaaccggggtaacggtaacccggtacggtaaccgtttaccgggaacccccggtttacgggtaaccggacccgtacccggaacccggttaccgggttaccccgaccccgggtcccccgtttaacggg

SEQ ID NO: 201479 - DNA, 837 bp, Homo sapiens
  misc_feature: GYAE6OF01BC0CG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctctcactctctgcacgaggctctgaggcctcctatgagctcgacacacgcccacccgtcggtgtcacggtcgtcccgaggacaggaccggtccgaggatccacctgactctgcagagtcgactacgaaccaaaagaactagtacgtacgttaagttacgaaccgtaagacggaacgtaccgacgggccctaccggtacccgttggtaggttaacggtagtaactaagttaaaactaaacgaaccgtaacggtaggtacggtaccggtacccttacgaagtaacgtaccgttacccgaggtaccggtaccgtaacgttttccgtaggtttaccggaccgttaccggaccggttaccgttacggaacgggtaaccacggttaccggtaacgtaccggtacgttaaccgtacgttaacgtcgtaacggtaacggtaaccggtacggtaacgtacgggtacggaacggacgggtacggtaaccgtacggtaacgttaccgttaacgtaacggtaaccgtaaacggtaacgtaaacggttaaccgaagttaacgggttacgttaacgttacgggttacgggttacggggttaccgggttaggggtaccggggaacgtaacccgggtaacgtaccggttaacgggtcccgggtaacggttaaccggtaccggtacccggtaccgggtaaaccgtcccggttaccccggttcccggttaccccggg

SEQ ID NO: 201480 - DNA, 663 bp, Homo sapiens
  misc_feature: GYAE6OF01AMTJS.21.46.E02.1.454.CMB.1.raw
  modified_base (165)..(165): a, c, t, g, unknown or other
  misc_feature (165)..(165): n is a, c, g, or t
  modified_base (219)..(219): a, c, t, g, unknown or other
  misc_feature (219)..(219): n is a, c, g, or t
  modified_base (264)..(264): a, c, t, g, unknown or other
  misc_feature (264)..(264): n is a, c, g, or t
  modified_base (329)..(329): a, c, t, g, unknown or other
  misc_feature (329)..(329): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacngcccaccctcggtgtcagtcgtccccaggacagacggccaggatcacctgctcngcagatggactcgacaaagaatatgtacttattcggtaaccaaanagaacgaccgacggccacggcccctgtagttagtgattaataataaagacatgagacggccctanagagtactcccgtagacgcgtacttcgtacgtcggctccgagcctacgaacgggtacacggcctaacgtccgttacggttacgtaccttagtacgtacggtagtaaaccgtccgagggtacgaacggggaacgggtaacggacggtaccgtagtaaccgtttaacttaacgtacgtaaccgaaaagtacggtaacgaaacgtaggttaagggtaacgtaaccttggttacggttgggttacggttccggacgggtaacgggacctaacggtcgtaccggtcccgtacgttacgaccgaacgacccgtaagggcccttacccggtcccgtaccgg

SEQ ID NO: 201481 - DNA, 766 bp, Homo sapiens
  misc_feature: GYAE6OF01DNNEC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctcgtgaggcctctatgagctgacacacgccacccgtggtgtcagtcgtccccaggacagacggccaggactcacctgctctgcagatggactcggaaccaaaaggaaatgtgtcttagttacggtaaccaacaagaacgccacgggccacggccccttaggtacgttagtagtataataaacgtaaaggaccacgtagaacggacggtacccctagaagacgtacctcccgtaggacgaccggttacttccgtcgtggtcccttaccgacgtccgtacggaacggggactacggaccgtaggttacctaacggtttcggaaccttaacgtacggtaagttaggtaaaccggttaccggaacgggaacgaagggtaacggggaacggtacggtaacgttacggtaaacctttaacggtttaaccgtaacggttaaacctaaaacggtaagggtaaacggtaaacggttaagggtaaacgggttaacgggtttaaccttaacggttaaggtttcgggggttacggttacggggaccggggttaacgggaaccgtaaacggtcggtaaccggttaccggtacgtaacggtaccgacggtacccgaaccggtcttccccgccccggttacg

SEQ ID NO: 201482 - DNA, 785 bp, Homo sapiens
  misc_feature: GYAE6OF01DU8BI.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcagtcgtaccccaggacaggaccggccaggactcacctgctctgcagatggactgaccaaaagtaaatntcgtactttagttacggtaaccaaacgaagaacgacccgaggaccgaccggtccccgttaggttaggttagtagtaattaagtaaagtaaacgactacgtagaacggaccggtaccctagaagacgtacctacccgtagacgacgtactttccgtacgtcggtcctaccgtacggtcctacggaacggacgacgacgtaacggttaccgtaacggtttacgtaacgttaacgttcgtaaggttacggtaaaccggtacccggaacgggtaacgaacgggaacgggaacggtaacgggtaccgttagtaacgtttaacgtttaacgttacgtaaacgtaaacggtaacgtaacgtaaacgtaagggtaacggttaacggttacttacgggttagggtttacggggtttacgggttccggggaaccgggaaccgggtaaccgtaacgggtaccggttacccggtacccggttaccggttacggacccgtaacggaaccccggtaaccgggtcccgttaccccggtcccccgttacgg

SEQ ID NO: 201483 - DNA, 798 bp, Homo sapiens
  misc_feature: GYAE6OF01ESD5T.21.46.E02.1.454.CMB.1.raw
  modified_base (370)..(370): a, c, t, g, unknown or other
  misc_feature (370)..(370): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacggcctcctatgagctgacacagcccaccctcggtgtcagtcgtccccaggacagaccggccaggactccacctgctctgacagagtggactacgaaccaaagaaatatcgtacttagttacggtaaccaaacgagaacgccgaacggccgacggccccgtagttgttaggtagataataagtaaaacgacacgtaggacggacggtccctagagacgactccgngacgcgtactttctacgtcggcctaccgacgtaccgtacggaacgggtaccacggtaccgtaacgttaccgttacggtttacgtaacgttaacgttaccgtaagggttaacgaaacggggttaccccggaaagggaacccggtaaaggggaacggggtaaccgggaacgggttacgtaacggtttaaacttaacgtttaaccggttaacggtaaaccgaaaagtaacggtaaacggaaaccgttaagggtaacgggttaacggtttaaccgttaggttaacggggtttcggggttacggggttaccggggaccggggtaaacgggtaacccggaacggttcccggtaacgggtacccggttacggtaacgggttacccgaaccggtacccgtaaccgggtcccgtcccccggtcccccggttacccgg

SEQ ID NO: 201484 - DNA, 832 bp, Homo sapiens
  misc_feature: GYAE6OF01CZ03H.21.46.E02.1.454.CMB.1.raw
  modified_base (143)..(143): a, c, t, g, unknown or other
  misc_feature (143)..(143): n is a, c, g, or t
  modified_base (157)..(157): a, c, t, g, unknown or other
  misc_feature (157)..(157): n is a, c, g, or t
  modified_base (183)..(183): a, c, t, g, unknown or other
  misc_feature (183)..(183): n is a, c, g, or t
tcagtcgtcgctcgcacgaccggtgctcgatttagactcatctacagggaaagggggtgggtccaggaggcagaactctgggtgtctcaccatggcctgaactccctctacttcctcccctctcactctctgcacgaggctcngacgcctctatgancgtagacacgcgaccctaccgtggtntcgacgtcgtacccgaaggacgacggaccggccgagtacctccaccgtgccttcgagacgaaggtcgtacggtaaccgtacgaaacgtaaaaggtaattcgtacgttaacgttttaacggttaccggtaaaccgaaacgaacggaaccgaccggtaccgggaccggtacccggtcccgttaggttacgttaaggtataaagtaacttaaacgtaacgaaccgtaggtacggaacggtaccgtacctacgaacgtacgtaccgtacgtacgtacgtacgttacgttcgtacgtccgacctacggacgttacgacggaacgtacgtacgtaccgtacgtttacgtacggttactacgttaacgtacggtaacggtacggtaccgtaccggaggtaaccggaagggaaccggtacggtagtaacggttaacgtaacgtttaacgtaaccgtaacggtaaaccgtaaaggtacgtaaacggtaacggtaacggttaacggttaccgtacgggtttaagttacggggttaacggtaccggggttaaccggaacgggtaacggtaccgtaacggttacccgggtacgttaaaccggtcggtaaacgtcccgtaaccgggtccgaccgggtaccccgttcccgacccggtttaccg

SEQ ID NO: 201485 - DNA, 751 bp, Homo sapiens
  misc_feature: GYAE6OF01BVU7W.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggactccaccgtgcctcgtgacagatcggactagaaccaaaagaaacttagtgtactttagttacggtaaccaaacgaacggaacgcccgaacggacccgaaccgggtcccccgttggttacggtttacggtacgtaagttaagtaaacgttaaaacgaccgtaacgtaggaacggtacgggtacccctacgaacggtaacgtaccgtaccccgttaggacggtacggtactttccgtccgtcggtcctacccgacgtccgttaccggacggggaaccacggacgtacgttacgtaccggttacgtactagtaccgtaggtacgtaacggtacccgagggacgtaagggaacgggtacggacggtacgtacgtaacttacgtttaaccgtacgtaaccgtaagtacggtaagaacgtaaggtaaccggttaggttaactacggtaggttcgggttcgggtaccgggacgggtacggaccgtacgtacgtacggtccgtcgtaacggtccgaccgaccggaacggtcccgtccgtccccgtaccgg

SEQ ID NO: 201486 - DNA, 619 bp, Homo sapiens
  misc_feature: GYAE6OF01BG9KA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagatggactgaccaaagaaatatgtctttagttacggtaaccaacgaagaacgaccacggccgacggccccttggtagttagtagtataataagtaaagacacgtaggacgacggccctagacgacgtactcccgtgaccgacgtacttccgtcgtcggtcctaccgtacgccgtacggacgggaccgtacggacctaggtaccgtacgttacgtactacgtacgtagtacgtacgtacgagacgaaggacggacgaggtacgtagtacttattactacgtaacaacgtagtaagagtaaggtagtagtacgtacgtagttacgggtcggtcggacggaggaccgacgtcgacggtccgtacgtaggcgtaccgacgacgcctcccgtccccgtcgg

SEQ ID NO: 201487 - DNA, 679 bp, Homo sapiens
  misc_feature: GYAE6OF01D7OBX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggactccacctgctcgtgcagagtggactgaccaaaagaatatgtctttagttacggtaaccaacgaagaacgccgacggccacggtcccctagttagttagtagtatataagtaaagacacgtaggacgacggccctagagagactccgagacgcgtattccgtcgtcggcctccgacgtcgtacggacggacgaggactaggtccgtacgttacgacttatcgtagtacggtaacgtaccgaggacgaggacggacggagggtctacgtacttacgttacgtacgtaacgaaacgtaggtaacgaacgtaaggttaacggtaacggttacgttacgttaggtttacggggtcggttaccggggacgggaaccgggtaaccgacggtaccggtaccggtacccgttaccggtaacggttacccggaccggaccccggtaaggtccccggttcccgccccccggttaccggg

SEQ ID NO: 201488 - DNA, 789 bp, Homo sapiens
  misc_feature: GYAE6OF01E3D5I.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgagcctcctatgagctgacacacgcccacccgtcggtgtcagtcgtccccgaggacaggaccggccaggtatccacctgccttcgtgcagatcggacctacgaaccaaaagtaatatgtactttaagttacgtaaaccaacgagaacggaccgaggcccgacggtccccgtggtagttaagtagtaattaataaagtaacgaaccagtaggacgtaccggccctacgagaacgtacgttcccgagaccgtaccgtactttccgtacgtcgtacctccggtaaccgccggtacggaacgggacctagtaccgtacggttaccgtacgtttaacgaccttaacgtcggttaacgtacggtaaaccgttacccgaacgggacgtaacgggaaacggtaccgggtaggttaccgtaacgtaaaccgttactttaaccggtacgttaaacggtaaacgtaggtaaaccggaacgttaaacgggtaacggttaaccggttacttaaggtttacggggttaggggttccggggtaccgggacgggggtaaaccgaccggtaccggttaacccggtaccgggtaacccggtttacggtaccgaaccggacccggacccgtacgggtccccgtacccccggtccccggttacccg

SEQ ID NO: 201489 - DNA, 681 bp, Homo sapiens
  misc_feature: GYAE6OF01BHGGZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagcctgacacacgccaccctcggtgtcagtcgtcccaggacagacggccaggactcactgcctctgcagatggactggaccaaagtaatagtgactttacgtaggacctaaacacggaacgcccgagggcccacggtaccccgttggttacgttagtagattaactaagttaaacggacaacgttggaacgtacggacccctagaacggagtacctcccgtagacgcgtacgttctcgtaggctccagtcgtagacggacagctaggtcctagtacgtactatacgatacggtacgtaccgaggtagacggtaacgggacgtacggtctacgtaacgttacgtaacgttacgtacgaaacgtagttaaacgaacgtaaggttaaacgtaccgttaactacgttacgggtttaagggtccgggttacgggacgggtaaacgggacctacgggtcttacccggtaccggtaccggttacgtaccgaccggtacccgtaacggtccccgttacccgcccccggtttacgg

SEQ ID NO: 201490 - DNA, 663 bp, Homo sapiens
  misc_feature: GYAE6OF01A3XWP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgcccaccctcggtgtcagtcgtcccaggacagacggccaggatcacctgctctgcagatggactgaccaaagaattatgtctttaagtaggtaaccaaacgtaagaacgccgacggaccgacgtccccgtagtagtagtgataataataacgacaacgtgacgacgccctagagacgtactccgagtacgacgtacttctcgtcggcctccgagtcctcgaggacagtcagtctacgttagacttacgtacgtagtaggtaacgtacccgaggtcgaaggagggtaacgaggtaccgttacgtaaccttagtttacgtacgtaaacgaaacgagttaacgtaacgaaggttaagtacgttacgttaacggttgggtttacgggtcgggttaccgggaacggggtaaccgggaacccgtaggttacccgtaacggtcccttacggtacggaccgaacccggtacccggtacgggtcccttccccggtccccgttaccgg

SEQ ID NO: 201491 - DNA, 709 bp, Homo sapiens
  misc_feature: GYAE6OF01BE7EN.21.46.E02.1.454.CMB.1.raw
  modified_base (217)..(217): a, c, t, g, unknown or other
  misc_feature (217)..(217): n is a, c, g, or t
  modified_base (346)..(346): a, c, t, g, unknown or other
  misc_feature (346)..(346): n is a, c, g, or t
  modified_base (410)..(410): a, c, t, g, unknown or other
  misc_feature (410)..(410): n is a, c, g, or t
  modified_base (541)..(541): a, c, t, g, unknown or other
  misc_feature (541)..(541): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctgacacagccaccctggtgtcagtcgtccccaggacagacggccaggactcgacctgttcngcagatggactgaccaagaatatgacttattggtaaccaacgtagagtaccgaggccaacggcccttagtcggtttagtgaattaagtaataaaggacctacgtaggacgtacggaccctacgaagganaaccgttcccgtaggaacgccggtatttcggtcgtacggcctacgaacgtccaacggacggacncgacgtacgtcgttacggtcctaagttcgtacgttaagtggtaacgcgaggtacaagggaaccgggaagtaccgggcttaaagggtacctttaagttaccgtaacggtaacgtaaaacgtaccgggttaanaacgggttaaaccggttaagggtaaaccgttaccgttagttaggtttacggggaccggtacgggttaggggaaaccggtaaccgtaaggtccgtaaccgtaccggttacgacggtaccgaacccgtacccggaccggtttaccgcccggttcccccgtgggttaaccc

SEQ ID NO: 201492 - DNA, 698 bp, Homo sapiens
  misc_feature: GYAE6OF01D06E8.21.46.E02.1.454.CMB.1.raw
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
tcagtcgtcgctcgcacgaccggtgctcgattttagactcatctacagggaaaggggggtgggtccaggaggcagaactctgggttgtctcacctatggccttggatccctctacttctcccctctcactctctgcacaggctctgaggcctcctatgagctcgacacagccctacccttcggtcgtcagtcgtcccaggacagacggccgaggactccgactgctntgcagatgactgacaaagaaatntgtacttattcggtaaccaaacgagaacgaccgacggccgacggcccctggttgttagtagagttaataagtaaaagaccatacggagaccggcctacgagacgactccgtagacgcgtacttctacgtcgtcctcaggcctaggacgggactggacgaacgttctacggttagacgttatacgagttaacgacgtaccgaaggacgaaggacggacgacggtacgtaacggtaacttaacgttacttacgtaaaccaagggtaaccgtaagtaaccggtaaggtaacgttaacggttacggttaacttagggtttcggggttacggtccgggggtaacgggtaaaccggggtaccggtaaacggtccggttacggtaaccccgtaccggtaacgttacccgaacggtaccccgtaacgggtcccgtcccggtaccccccggttccgg

SEQ ID NO: 201493 - DNA, 612 bp, Homo sapiens
  misc_feature: GYAE6OF01EN364.21.46.E02.1.454.CMB.1.raw
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (460)..(460): a, c, t, g, unknown or other
  misc_feature (460)..(460): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagacggcgaggactcacctgctcgtgcagagtggactgaccaaaagaatatgtactttagtcggtaaccaacgaagaacgccaggccgaggacccctggtacgttagtgataataataaagacagtgagacggcctgaagagctcccgtgacgtcgtatttcgtacgtggtccncgacgcgtacgacgggaacngtacacggtcgtacgttacggtaactacgtacgtaggtagtaaccgtcgaaggaccgaggaacggacggngtactagtacttaattcgtagtaacaagtagaacgtacgtaagtaggtagttactaggttagttaggggtcggttgggaccgggaggaaccgtagcggtaccgtcccggtacgtagtccgacggtacccgagtccgtcccgtcccgtcccgg

SEQ ID NO: 201494 - DNA, 826 bp, Homo sapiens
  misc_feature: GYAE6OF01CN635.21.46.E02.1.454.CMB.1.raw
  modified_base (182)..(182): a, c, t, g, unknown or other
  misc_feature (182)..(182): n is a, c, g, or t
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacgaggctctgaggtcctcctatgagctagacacagccacccgtcggtntcagtctcccgaggcagacgcagancactgctctgcagntgactacgacaaagaatactgtacttacttacggtaacaacgtacgaacgccgaacggaccctaccgggtcccccttaggttacggttaacggtagttaacgttaaacgttaaaacggtaaaccgtaaccgtaaccggttacggaaccggtaaccggtaccccgttaacggtaaaccggtaacggtacccgttaccccggttaggacggtaaccggtttacctttaccgtccgtttaccggggtacccttacccggtaccggtacggtaccggtaacggggaaccgtacgtacgtaaccggttacggttaacggttacgtacttacggtacgaacggtttacggaaccggttaccgacgggtaaacgtaacggaacgggtaccgggtaacggtacgtacgttaaaccgttacgtttaaccgtacgtaaacgaaacgttaggtaaacgtacgggtaaagtacggttaacggttaacttggtacggttcggggttcgggtaaccgggtacgggaacgggtaaccgtcggtaccgggtacgttaccccggtaggtacgttaccgtacgggaccctacgggtacccccgtccggttccccgtaacccgg

SEQ ID NO: 201495 - DNA, 830 bp, Homo sapiens
  misc_feature: GYAE6OF01BWGZX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggaggccctcctatgagctgacacacgccacccgtcggtgtcagtcgtccccgaggacacgaccggccaggactaccaccgtgcctctgccgagagtaccccccccggatacgaaccgaaaagtaaacttagtgtactttagttacggtaacctaaacgacggaacgacccgaacgggaccgacggtccccctggttagttaacgtagtaagttaagttaaacgtaaacgacctaacgtaggaacggtacggtacccctacgaagacgtacctcccgtaggtacgtacggttactttccgtcgttcggacccttacgacggtaccgtacggaaccgggaacgacggacgtacgttacgtaccggttactaaccgttctacggtacggtaacggtaacggtacccgacggtacggtaacgggaacgggacgaacgggtacctaacggtaacttacgttaacgttacggaaacctaaacggtacgtaaggtaaccgtagggttaacgggtaacgttaacccgttagggttaacgggtttcgggggttaaccgggttaccggggaaccggggtaaaccgggtaaccggtaaccggttcggtaaccccggtcccggttaaccggtaccggtaccggtaacccggtacccgggtaacccgtcccggtaccccccgttcccgggttaaccccgg

SEQ ID NO: 201496 - DNA, 824 bp, Homo sapiens
  misc_feature: GYAE6OF01ES83F.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctctgacggcctcctatgacgctcgacacacgccctacccgttggtctcgtacgtccgtaccccgaggacgacgaccggcaacggtactccaccttcgccttcnggactagcgtcggtaactacgaaccgtaaaagtaattagtacgttacgtttagttaaccggaaaccgaaacgaacggaaccgaccggaccggacccgtaaccggttccccgttaggttaggttagtacgtaattaactaaacgttaaacgacgtacggtaaggaaccggtaccggttccccgtaagtaacgggaacctaccgttacccggttaaggtaccggtaccgtttaccgtttaccggtccggttaaccgggtaccctaccggtacggttaccggtaaccggaacggggtaacccgagttaccggtacgtacgttaaccggtttacgtaacgttacgtaacggacgttacgggaccgtaacgacgggtacggaaggtacggacggacgttctaacgtattacgtaccgtaacgaataacggtgtaacggagtacggtaggttaccttaagttcggttagggttccggggttacggtacgggtaacgggaaccgtacggtaagtccggttaccggtcccgtaccgtaccgttacggacccgaccggtacggtcccccgttaaccgtccggttacccg

SEQ ID NO: 201497 - DNA, 1085 bp, Homo sapiens
  misc_feature: GYAE6OF01A3RPP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtcccccaggaccaggaccggccaggactccacctgcctctgcagactggactgaccaaaagaatatgtacttagttcggtaacctaacgaagaacggaccgacggacccgaacgggtcccccgttggttacggttttaacggtacgtaaagtttaaacgtttaaataaaacgggtaacctaaccggttcgggaaacggtaccggtacccccttacggaaacggtaaccgggtaacccttacccccggtttaggaacgggtacccggttaaaccttttttcccgtcccggtttccggggtacccccttaccccgtaaacgggtccccgttaccggggaaccggggtaacccgtaacgggacccggtaagggttaaccccggttaaccgggtttacggaacccgtttaacggttaaccggtaaaccgggtttaacgggaaaccccgggtttaccccggaaacggggtaaccccggtaaaggggtaaaacccgggggtaacccgggtaaaccggggtttaccggttaccggttaaacccgtttaacggttttaacccggtttaacgggtaaaccccttaaaaacggttaaacgggtttaaacggaaccggttaaaccggggtaacggggttaaaacccggtttaacggttacccggtttaacggggtttaccgggggtttccggggtttaaccggggggacccgggggaaacccggggttaacccgggtaaacccggggttccccgtttaaaccccggggggttaaaccccccggtttaaccccggggtttaacgggggttaacccccggtaaccccggggtaaaccccccgggttaaccccggggtaacccccgggtttcccccccgggttaccccccccccgggtttaaaccccggggg

SEQ ID NO: 201498 - DNA, 823 bp, Homo sapiens
  misc_feature: GYAE6OF01CFZSH.21.46.E02.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagactcatctacagggaaagggggtgggtccaggaggcagaactctgggtgtctcaccatggcctggactccctctacttcctcccctctcactctctgcacaggctcgtgacggccttctatgagctacgaccacacgccctacccgttcgggtcgtcacggtccgtacccgaggacacggaccggcaggactccacctgctacgngacagtactcgggtacaacgaacgtaaaagaacttagttacggtactttacggttaccggaaaccaaacgacggaacgaccggaaccggtccggtacccggtacccgttaggttaggttaacggtattaaataaagttaaaccggaaactaacgtaagtacgggaaccggtaccggtccccgtaagtaaggtaaccgtacctacccggtaagggtaccgtaccggtttattcccgacggtttacggcccttacggacgttacgacgggtagggacacgtaccggacgttaccgttaacggttactacgttaacgtacggaacggtaacgtaacggtcgaaacgggtacggaaggacgggtacgacggttacgacgtttaactaagtttacgactaaacgttaacggtaagtaacggagttaaaggtaccggttaagttacgggttcgttaacgggttcggggttaaccggacggggtaccgggaaccggtacgttaaccggacggttacccggtaacggtttccgacggggttaccacgggttaccccgtaccggtcccggtaccccggttaccggttcccgg

SEQ ID NO: 201499 - DNA, 698 bp, Homo sapiens
  misc_feature: GYAE6OF01C5ZE8.21.46.E02.1.454.CMB.1.raw
  modified_base (134)..(134): a, c, t, g, unknown or other
  misc_feature (134)..(134): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (403)..(403): a, c, t, g, unknown or other
  misc_feature (403)..(403): n is a, c, g, or t
  modified_base (541)..(541): a, c, t, g, unknown or other
  misc_feature (541)..(541): n is a, c, g, or t
tcagtcgtcgctcgcacgaccggtgctcgatttagactcatctacaggggaaagggggtgggtccaggaggcagaactcgtgggtgtctcaccatggcctggactcctctacttctcccctctcactctctgcngaggctcgtgacgcctcctatgagctagacacacgccacccgtggtgtcgacgtcgtacccgaggacacggaccggcgaaggctacactgctcgtgacggtagtcggacctgaaccgaaaaggtatagttanacgttttaagtaccggtacaaacgaggaacncgacggaccacggtccctagttagtagtgtaataagtaataaaggaccaagtgaacgggaccgtcccagacggactactacccgtagacgtacgtacttcgttacncggtcctaacggcaccgaacgggtacgaagacgtaccggtatacgggttaacctacggtacgttaggtacgtaggtacggtaacgaaccggagacgaaggtaacgaggacggtactagtaaccgttattaaccggtanaaccgtaaactaggaacaaggtacgtaaaggtacgtaagtacgttagggtacggttagggttacgacggggtacgaaccgagggtaccttacgggtacgtaccgttaggacccgtaacggtaccgaccgtaaccggcccgttaccgtcggtaacccg

SEQ ID NO: 201500 - DNA, 854 bp, Homo sapiens
  misc_feature: GYAE6OF01BSJN5.21.46.E02.1.454.CMB.1.raw
tcagtcgtcgctcgcacgaccggtgctcgatttagactcatctacaggggaaagggggtgggtccaggaggcagaactctgggtgtctcaccatggcctggatccctctacttcctcccctcctcactctctgcacgaggctctgaggccctcctatgacgtctagacacgacgcccctacccgtcggtacgtccgacggttccggacccccgagggaaccgacggacccggacccggaaggtaccttaccacccgtcggtcctaccgtcggacgaaggtacgtacgggactacggaaaccgtaaaaaggtaaacttagttacgttacgttttaacgttaaccggaaacccaaagaacggaacggacccggacggacccggaaccggtcccgttaggttacggttaaggtagtaaagttaataaacgtaaacgactacggtaggacgtacgtacctacgaacgtcgaaccttccgtaagacggtcgtaacgtttccgtcgtaccggcctacgtacgtaccgacggaagggtacccgaggccgttaagtaccgtacgtacgtaacgtcgtacgaagggtaacggaccgtaacgggtacggaacggacgggttaacggaacgtcggtaaccgtagtttaccttaagttaacccggataaaccgtaacggttaacgtaaggtaagggttaaagaccggttaaacggttacgttaacgggtacgggtttcggggaggggttaacccggaacggggtaccgtaaaccgggtcgttaccccgggtacggacccgggttaccggtaacggtaccgacccggtaaccgggtcccggtacccgtccccggtcccggggtaccc

SEQ ID NO: 201501 - DNA, 803 bp, Homo sapiens
  misc_feature: GYAE6OF01D7NCC.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttcctcccctcctcactctctgcacaggctctgacggcctctatgacgctcgacacacgcccaccgtcggtcgtcgacggttccgtacccgaagggaccgacggaccggaccgaaggtactccgaccgtcgtccgttcgtcggacaggtacgtacggactacggaaaccgtaaaagtaaacttacgtacgttacgtttacgttaaccggtaaaccgaaacgaacggaacgaccgaccggaccgtaccggtcccttaggttaggttaagtagtaataagtaaacgtaaacgtaacgtacggtacggacggtaaccggtaccgtacggaagtaacgtaccgttaccgtaggtacgtacgtttaacgttccgtcggtaccggtacctaccgtacgtaccggtacggaacggacgacggtacgtacgtacgtacgttacgaacttacgtacggtaacgtacgaacgacggaacggaaggaagggaacggacggtagtaccgtacgtaactttaacgtacgtaacgaaaccgtaaagacggttaacggaacgttaaacgggtaacggttacgttacgttcggttaagggggtttcggtacggggacccgggtaagggaacggtaccggacgtacgggtaccggtacgtacgtacgggacaccggtaacccgtacggtcccgttacccggtcccgtaccg

SEQ ID NO: 201502 - DNA, 832 bp, Homo sapiens
  misc_feature: GYAE6OF01DGZZA.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctctgacggcctctatgagctgacacagcccacccgtcggtcgtcaggtcgtccccgaggacgacggaccggaccgaaggactccaccgttgccttacgtgacaaggtacgttacgggaacctacggaaaccgtaaaaaaggtaaattagttacggtaacttttaaacgtttacggttaaaaccctaaaacgtaaacggaaaccggtacccgaacggacccgaaccggtacccccgttaggttaggttacggtacgtaagttaaacgttaaagtaaacgtaacgtacgtaacggacggtaaccggtacccgtaacaacggaacgtaccgtacccgtaggaacgtacggtaactttccgtcgttacggacttccgaagtaccgacggaacgggaccgtaagaccgtaaacgtccgttaacggttagtaacgttacgtaccgtaaagtacgtaacggaccgacgggaacgaacgggaacggtacgacgggtaccgttagtacttaacgttaacttacggtaaacctaaaggtaaacgtaacgtaaacgtaacgggttaggtaacgttacgttaacgttacgggttaggggttaccggttacgggtaacgggaaccgggtaacgtaacgtccgtacggtacccgtacgtacgtaaccgacggtaaccgagttacccgtccgtccccggttaaccg

SEQ ID NO: 201503 - DNA, 734 bp, Homo sapiens
  misc_feature: GYAE6OF01DE6DA.21.46.E02.1.454.CMB.1.raw
  modified_base (724)..(724): a, c, t, g, unknown or other
  misc_feature (724)..(724): n is a, c, g, or t
tcagtcgtcgctcgcacgaccggtgctcgatttagactcatctacagggaaagggggtgggtccaggaggcagaactctgggtgtctcaccatggcccggatccctctacttctccccctctcactctctgcacaggcctctgcgccctcctatgacgctgacacacgcctacccgtcggtgtcagtccgtaccccgaggacacggacggacaggactccaccgtgtctctcgacaaggtagtacggactacggaaccaaaaggtaattacgtacgttacgtttacgttacggaaaccaaacgacggaaccggaccgtaacggacccgtaccggtacccgtttaggttaggtttacggtagttaaattaaacgtaaagtaaacgtaacgtacggttacggaacggaccggtacccgtagaacgtacgtaccgtccgtagacgttacgtactttcgtaccgtcgctacgacgtcctacggacggaccagtacgtacgttaacctacgggtaacttacgtaacgtaacgtaggtaccgaacgtacccggaggaaccggagggtaagggacgtcggttaacgtacttacgtaacgttacgtacaaacgtagtaacgaagtaacgaggttaggaccgttagtacgtaggggtttcggcggttaccgggaaggtaccgacgtacgaccgtacgtaccggtgtacgcgaccgtaccgtacgccgtacccncgtcggtacc

SEQ ID NO: 201504 - DNA, 665 bp, Homo sapiens
  misc_feature: GYAE6OF01AVK51.21.46.E02.1.454.CMB.1.raw
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctagaggcctacctatgagctgacacacgccaccctcggtgtcagtcgtccccagggacagaccggccaggatcacctgcctctgcagagtcggactggaccaaaagtaaatatgtactttattacggtaacccaagaagaacgccgacggccacggccccttggttacgtagtagataatataaacgcacgtgaacgcggccctanagacnctaccgtgacgcgtattcctcgtggcctacgacgtccgtacggaacgggaccacggcctaaggtccttaacggttagtacttactacgagtacgaacgtaccggaggaaccgaggaggaccgggtagtcgtagtaactactttacgtataaccaaacggtgtagaacgtaggttaacggtacgttacgtagtaggttcggggttcggtaccgggaggggtaaaccgggacctaacgggtctaaccgggtacccggtaccgttaaggtcccgtaaccgaccccgaaggtcccctacccggtcccccggttacgg

SEQ ID NO: 201505 - DNA, 787 bp, Homo sapiens
  misc_feature: GYAE6OF01EIPX3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacacgcccacccgtcggtgtcagtccgtaccccgaggaccaggaccggccaggactccaccgtgccttctcgacagtacgtcggacctacgaaccaaaagtaaatgtacgtactttagttacggtaaccaaacgaaggaacgcccgacggacccgtaccgggtcccccgttaggttagttaacggtagtaaactttaaacgtaaagttaaaacggacctaacgttagggaccggtaccggtacccctagaacggtaacgtaaccgttacccgtaggtacgtaccgttacgtttccgtcggtaccgtcctaccgtacgtaccgttacggaacgggtacgacgtacgtacgttaccgtacgttacgtaacttacgtacgtacggtaacgtaacggtaccgagggacaagggaaccggacggtacggtcgtaacgtacttaagtaccgtaacgtaacgaaagtagtaacgtaagtaagggtaacgtaacgttacgttaggttaggttacgggtcggtaccgggtacgggtaaccggaccgtaacggtcgacggttacccgtaccggtaacggacccgtacccggtaacccgtaaccgggttcccgtccccggtccccggttaaccgg

SEQ ID NO: 201506 - DNA, 876 bp, Homo sapiens
  misc_feature: GYAE6OF01DXFAC.21.46.E02.1.454.CMB.1.raw
  modified_base (135)..(135): a, c, t, g, unknown or other
  misc_feature (135)..(135): n is a, c, g, or t
  modified_base (264)..(264): a, c, t, g, unknown or other
  misc_feature (264)..(264): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacnggctcgtgagcctcctatgagctagacacacgccacccgtggtgtcagtcgtacccaggacacggaccggaccagggaatccaccgtgctcgtgacagtagtcggaactcgaaccgaaaagtaaacttntacgtactttagttacggtaaacctaacgaacgaacgaccgaacggaccgaccggtccccgtaggttcggttaacggtagtaacgttaaattaaacgtaaaacgtaacgacgttaacggaacgggtaccgggtccccgtaacgaaggtaacgtacctaccgtggaacgtacgtaacgtttcgttcgtcggtccttaccacggaccgttacggaacgggaccgaggtaccgtaacggtaccgttaacggtttacgtaaccgttacgtaacggtaacggttacgtaaaccggttacccggaagggaaccgaagggtaacgggaacgggtacgtacggttacgtaaacgttaacggttttaacgtaaccggttaaacgaaacggttaaaccggtaacgtaacgggtaaacgggttaacggttaacgggtttaacccgtaagtttacggggttttacgggggttaaccgggttccgggggaaacccggggtaaccgggggtaaacccgttaacgggtaccgggttacccgggtaaccggttaacccggttaccgggtaacccggcggtaaaccccggcgggttaacccccgtccggttccccccgttaacccgggg

SEQ ID NO: 201507 - DNA, 620 bp, Homo sapiens
  misc_feature: GYAE6OF01EAVA0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcactgctctgcagatggactgaccaaagaaatatgtacttattcggtaccaacagaacgccaggccacggcccctgtagttagtgatatataaagacactgacgacggtccctgagacgactccgtagacgcgtacttctcgtacggtcctaccgagtcctacggaacgggtacgacgtacgtacgtcctacggtttagaaccttagtccgaaggtacgtaaacggttacccgaaggaccgaaggtacgggacgtacggtctacgtaacttacgttacgtacgtacgaaacgtaggtacgaacgtagtaaggacgttactcgtaggtttacgggtgttacgggcggaacggaccgtagtcgtcgtacccggtcgtaggacctaggacccgtaaggccgtcccgtccccgtaccg

SEQ ID NO: 201508 - DNA, 1028 bp, Homo sapiens
  misc_feature: GYAE6OF01EC34O.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgcccacccgtcggtgtcagtcgtcccaggacaggacgccgaggactccgacctcgctcgtgacgagagtcggacctacgaaccaaaagtaaattacgttacgttactttaagttacggtaaacccaaacgtaacggaacgacccgaacgggtacccgtaaccgggtcccccgttaggtttacggtttacggtagtaaagtttaaacgttaaacgtaaaaacggtaaccgtacggtacgggtaacggtacccggtacccgttaagaacggtaacggtacccgtttaacccggaggtaaccggtaccgtttaacgtttcccgttaccggttacggtacccgttaacctacgggtacccgttaaaccgggaacgggggaaaccctacgggttaacccgttaaccgggtttaacccggtttaaccgggtttaaccggttaaccgttaaccggttacggttaaacgggtaccggtttaaaccgggtaccccgggtaaacggtaaccgggaacgggggtaaaccgggaaccgggtaacgggttaccttaaaccggttaaccgttttaacgtttaaccggttaacggttaaaaaccgtaaacgggtaaccggttaaaccggtaaacggttaaacggggttaaacgtttaaacgggtttaaccgtttaacgggtttacgggggtttacggggtttaccggggtaaccggggtaaccgggggtaaaccgggtaaacccgttaaacggggttacccggttaacccgggtaccccggtttacggggttaaaccccggtaacccggtaaccccgggttaacccggtacccgggttacccccggttcccccgggttaccccccggttaaccccggg

SEQ ID NO: 201509 - DNA, 834 bp, Homo sapiens
  misc_feature: GYAE6OF01BTWDJ.21.46.E02.1.454.CMB.1.raw
tcagtcgtcgctcgcacgaccggtgctcgatttagactcatctacagggaaaggggtgggtccaggagacagaactctgggtgtctcaccatggcctggatccctctacttctccccctcctcactctctgcacaggctctgaggcctctatgagctgacacagcccacccgttcggtgtcaggttccgtacccccgagggaccaggaccggacctaaggactccacccttgccttctggacagtacgtcggaacctggaaccaaaagtaaactatcggtactttagttacggtaaccaaacgaaggaacgcccgaacggacccgaacggtcccccgttaggttacggtttaggtagtaacttaattaaagttaaaacgaacctacgtacgggaacggtaaccgggtaccccttagaacggtaacgtacgttaccccgtaggacggaccgtactttccgtacgttcggtaccttccgacgtccggtaacgaacgggaccaacggtccgtaacggttaccgtaacggtttcgaaccttagttaccgaaggttacgtaaacggttaccgacggaccgaagggaacgggacggacgggttactaacggtaacgttaacttaaccgtaacgttaaaccgaaacgtaaggtaaccgtaacgtaacgggttaacgggtaacgttacttaccggtttaggttacggggttacgggttaccggggaccgggtaaacgggtaccgaacggttaccggtaacccggtaccggttacccgtacgggtaaccggtacccggtaaccggtaaccggtcccgtaccccgggtcccccggttaacccgg

SEQ ID NO: 201510 - DNA, 589 bp, Homo sapiens
  misc_feature: GYAE6OF01E4IGN.21.46.E02.1.454.CMB.1.raw
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaatatgcttatgtaaccaacagaagccaggccacggcccctgtgttagtgatataanaaagacacgtgagacggccctnagacgactcccgtagacgtcgtacttctcgtcggtcctaccgagtcctacgacgggacacgacgtagtctacgttcgtactagtacgacgtacggaacgtccgaggacgaggaacggacggaggacgtagtacttaacttacgtacgtacaaacgtagtaagacgtagtaagtacgtactagtagttgggtgtcggacgggtacggacgacgtacgtacgcccgttacgtacggtaccgacgtacccgaacggtcctcccgccccgtaccgg

SEQ ID NO: 201511 - DNA, 642 bp, Homo sapiens
  misc_feature: GYAE6OF01ANYNB.21.46.E02.1.454.CMB.1.raw
  modified_base (244)..(244): a, c, t, g, unknown or other
  misc_feature (244)..(244): n is a, c, g, or t
  modified_base (297)..(297): a, c, t, g, unknown or other
  misc_feature (297)..(297): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtcgtccccaggacagacggccaggatcacctgctctgcagatggactgaccaaaagaatntgtacttattacggtaaccaacgagaacgccaggccacggtcccctgtgttangaatataataaagacacgtggaacgcggcccctagaaggacgtactcccgtagacgtcgtactttccgtacgtcggacccttccgaacgtccgtacggaacggggacacgtccgtaagtcgtacgttagaccttagtacaggtagacgtaccgaggtacgaagggaacggacgtaaggtccgtataaccgttagtactacgtaacaaacgtagtacgaacgtaggtaacggtaagtactacgtaggtttggtacggtacggacgggaacggtaacgtacgccggtacggtaccgtacgttacggccgtaacggaccgtaccggtcctccccggtccccgtaccgg

SEQ ID NO: 201512 - DNA, 864 bp, Homo sapiens
  misc_feature: GYAE6OF01AURH6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggtcctcctatgagctagacacacgccctacccgtggtctcacgtcgtacccgaggacgacggaccggcgtaaggactaccaccgttcgaccttctacggcgaagtacgtagggacctacgaaccgaaaaagtaattcgttacgttaacgtttacgttaaccggttaacccaaacgtaacggaaccgacccgtaaccgggacccgtaccggtaccccgttaggttacggttacgtagtaaatttaagtaaacgtaaacgaaccgtaacggtacggaacggaccggtaccctaggaacgtaacgtaccgtaccgaggtaaccgtacgtccgtttacgtcggtccggtaccctaccgacggtccgtacggacggtacccgagtaccgtacggttaccgtacgttacgtaccgttagttaccgtaggtaacgtaaccggttacgaacggtagaacggggaacgacgggtacggacctaacggttacctaggttaccgacgtaaacgtaacgtaggtaacgaaccggttaaaggtacggttaccggttaacgttacgggttaacggggttcgggttaaccggggtacggggacccgggtaaaggttacccgggaaccgtttacgggtaccccgggttaaaccggtaccggggttaaccggaacccggtacccgggaacccgttaacccgggacccgtttcccccgggtccccgggttaacccg

SEQ ID NO: 201513 - DNA, 774 bp, Homo sapiens
  misc_feature: GYAE6OF01CWXHO.21.46.E02.1.454.CMB.1.raw
  modified_base (654)..(654): a, c, t, g, unknown or other
  misc_feature (654)..(654): n is a, c, g, or t
  modified_base (672)..(672): a, c, t, g, unknown or other
  misc_feature (672)..(672): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcagaggctctggacgtcctctatgacgctgacacacgcccacccgtggtcgtcgacgtccgtccccgaaggaccgacggaccggaccgaggtactaccgtaccgtcgtcctccgtgacgaagtacgttacgggacctaacggtaaacctaaaaagtagttagtcgttaaccgtttaagttaaccgggaaaccaaacgaacgaaccgacgacggaccgaccggtacccgtggttacgttagttacgtaattaactaaagtaacggaacacggtacgaacggtaccggtacctagacggaactccgtacccggtaagtacggacgtttacgttccgtacggtccggtacctaaccggtaccgtacgggtaacggggccgggtacggtacccgtaggtttactcgtttcggaacgtcggggtaccgggtacgtaggggttagagggtcgttaacggagtacggtaacctaacgttaccgttaacggttacttaccgtacgaaggtacacggtaccgaggttaaccgngtttaggacttaacgggnggggtaaccggtctaaggggtccgacgggtacggtacggtacggtaccggtacggtctaccggcgaacgtccggacttcccggacccgtcgtccgcttcccg

SEQ ID NO: 201514 - DNA, 864 bp, Homo sapiens
  misc_feature: GYAE6OF01EIZ84.21.46.E02.1.454.CMB.1.raw
  modified_base (222)..(222): a, c, t, g, unknown or other
  misc_feature (222)..(222): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacgaggctctgacggccctctatgagctagacacagcccaccctggtgtcagtcgtcccaggacaggaccgcaggatccacctgctcngcagatggactgacaaagaatagtgtactttagtacggtaacccaagaagacgaccgacgggccaaccggtccccttaggttaggttaggtacgtaatttaacgtaaagttaaaacggaaccgtacggtaaggaaccggggacccggtaccccgtagtaaacggaacgtaccttcccccggtaggacgtaccggtaactttccggttccgtcggccctaccggtacgaccgtaccggaacgggtaccgagtacggaaaccgttccgttacggttaccgtaacttacggtaaccgtaaggttaccggaaaccggttacccgggaaggtaccggaaagggacggggtaacggtaggtcccgttaagttaaccttaagttttaaccgacggtttaaaccgaaaggtacggtaaaggtaccgtaaggggtttacgaaacgggtttaaccgttgggtttaacgggggtttcgggggttaaccggttaccgggggggtaaacgggtaacccgggtaaacccggttcgggtaacggttaccccggtaaaccccggggttcccggtaaccgggtaaccccggtaaaccccgggtaccgggttaaaccccgggttcccggtaccccccggttcccccgggtttaacccggg

SEQ ID NO: 201515 - DNA, 676 bp, Homo sapiens
  misc_feature: GYAE6OF01BUINH.21.46.E02.1.454.CMB.1.raw
  modified_base (107)..(107): a, c, t, g, unknown or other
  misc_feature (107)..(107): n is a, c, g, or t
  modified_base (180)..(180): a, c, t, g, unknown or other
  misc_feature (180)..(180): n is a, c, g, or t
  modified_base (205)..(205): a, c, t, g, unknown or other
  misc_feature (205)..(205): n is a, c, g, or t
  modified_base (215)..(216): a, c, t, g, unknown or other
  misc_feature (215)..(216): n is a, c, g, or t
  modified_base (240)..(240): a, c, t, g, unknown or other
  misc_feature (240)..(240): n is a, c, g, or t
tcagtcgtcgctcgcacgaccggtgctcgatttagactcatctacagggaaagggggtgggtccaggaggcagaactctgggtgtctcaccatggcctggatccctntacttcctccccctcctcactctctgcacaggctctgaggcctctatgagctgacacagcccacccgtcggtntcagtcgtcccaggacagacgcagntcactgctcnncagatggactgaacaaagaaactntgtcttattacggtaaccaacagaacgcacggccgacgtcccgtaggttgtaagtacgaataagtaaactaaacgacgtacgtaggaacgaccgggtccctacgaaggtaccgtacgtacccgtaggacgcgttacttctacgtcggctaccgagtccgtacgacgggacaccgtcgtagtccgtagttacgacttagacgtagtacggaacgcgaggacgagggacgacgtacggtcgtagtaacttacgttacgtacgtaaactaacgaagtagtaacgtaaggtaacgtacggttactcggttaggttaccgggtcggtaacgggaaccgggtagggaaccgtaggtacccggttacggacccgtttaacccggaggtaccgaaccccggtaacggtaacccgggttcccgtcccccggtccccgttaaccgg

SEQ ID NO: 201516 - DNA, 591 bp, Homo sapiens
  misc_feature: GYAE6OF01BH8RM.21.46.E02.1.454.CMB.1.raw
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
tcagtcgtcgctcgcacgaccggtgctcgatttagactcatctacagggaaagggggtgggtccaggaggcacaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgtactttagttcggtaaccaaacaggaacgccgaaggcccacgggccccctggtcgttagtgataataataaagacactgagacggccctanaganactccgtgacgcgtatttccgtacgtcggcctccgacgtctaccgagggacagaccagtcctacgttacgactactacgtagtacgaacgtccgaggcgtaaggacggacgaggtctagtaacttagttactacgaacaacgtagtaagacgtagtagacgttactacgtagttggtcggtcggacggaggacgagtctacggtccgtaccgtacgaccgacgaccgagtcccgtcccgtccccgtaccg

SEQ ID NO: 201517 - DNA, 734 bp, Homo sapiens
  misc_feature: GYAE6OF01EZ0T8.21.46.E02.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtccagtcgtcccaggacagacggcaggactcacctgctcngcagatggactcgaccaaagaactgtacgtacttagttacggtaaccaaacgtacggaacgaccgacggaccgacgggtacccccttaggttcgttaaggtacgtaattaagttaaacgtaaaacggacctacgttacggaacggtaccggtaccctacgacggtacgtaccgtccccgtaggaacggtactacgtttcctccggttcggaccttccgacggtaccgacggtaacggggtaccaggaaccacggttaccgttacgttacgtactacgttaacgacggttaacggaacgttaccccgaagtaccgagggaacggtaccggaggtctacgtaaccttaagtttaccgtacgtaaacgtaacgtaagaagtaccgtaaagggtagtaacgttacacggttaggtgggttacgtacgggacggaagggtaaccgagttaccgaccggtaccgttaccggtaggtacccgtacggacccgtacgggtaccccttccggccccgttaaccgg

SEQ ID NO: 201518 - DNA, 789 bp, Homo sapiens
  misc_feature: GYAE6OF01BJUH5.21.46.E02.1.454.CMB.1.raw
  modified_base (444)..(444): a, c, t, g, unknown or other
  misc_feature (444)..(444): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgacttattacggtaaccaaacgagaacggaccaacggtcccgaccggtacccgttggttaggttagtaggtaattaagtaaacgttaaacgaacctacgtacggaaggaccggtacccctagaaggacgtaccgttaccgaggaacgtccgttaacttccgtccggtcggtcccgtaccgtacgtccgtacggaacgggaacncgtaaccgtcgtacggttacgtacgtacctaagtacgtaggtacgtaaccggtacccggaagggtacggaagggaacgggtaacgggacgtacgttaacggtaacttaacgtttaaccgtagtaaaaccgtaaggtaaaccggtaaggaaccggttaaagggttacggtaaacgggttattaacggttacggggtttaacgggggttcggggttacccgggaacgggggtaaccggtaaaccggtaccgggttacggtacccgggtaacccggttaccgggtacgttaacccggaaccgggaccccgtaacgggttccccgtcccccggttcccggttaacccgg

SEQ ID NO: 201519 - DNA, 1178 bp, Homo sapiens
  misc_feature: GYAE6OF01CE6I0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacctcggtgtcagtcgtccccaggacacgacggccaggatcacctgctctcgcagatggactcgaccaaaagaatatgtacttaacgttacggtaaccaaacgtaaggaacggacccgacggtcccgacggtcccccgttaggttacggtttaggtacggtaaatttaagttaaaacgttaaaaacggaacctaaaccgttacgggaacggtaacccgggtaccccttaacggtaaacggacggttaacccgttaccccggttacggaacgggtaaccggttactttttaccgtacccgggtttccgggtacccgtttaacccggtacggttaacccggttaccggggaaaaccgggggaaccgtaaccgggttaaacccggtacgggtttaaacccggtttaaacccgggttttacggtaaacccgtttaacggttaacccggttaacgggggtttaaacccggtaaacccggggtttaaccccggaaacgggggtaccgtaaaacggggggtaacgggggtaaaccggggttaccggggtaaccggtttaaaacgggttaaaccgtttttaaaccggttttacccggttaaaaccgggtttaaaacccggttaaaaaaccggttaaaaccggggtttaaacccgggtaaaacccgggtttaaacggggttaaaacccgggtttaaaccggggttttaaacccgttttaaccgggggtttaaacgggggtttttttcccgggggggttaaacgggggttttaacccccggggggtaaaccgggggggaaacccgggggttaaaaccccggggtaaacgggtttacccccggggtttaaaccccgggggtttacccccgggttttaaaccccggggttaacccggggggtttaaccccggtaaaaaccccccgggggttaacccccgggttaaaaccccgggggtttccccccccgggttaaaccccccccggggttttcccccccccgggttttaaacccccgggggg

SEQ ID NO: 201520 - DNA, 809 bp, Homo sapiens
  misc_feature: GYAE6OF01BBAWY.21.46.E02.1.454.CMB.1.raw
  modified_base (358)..(358): a, c, t, g, unknown or other
  misc_feature (358)..(358): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacaggaccggccaggtactcaccgtgctcgtgcagagtggactggaacctaaaagaatatcgtactttagttacggtaccaaactaggaacgaccgacggccaccggccccttgtcgttagtagtataatataaagacacgtagagcggtcctagacgagactccnggacgcgtactttcgtacgtcggacctcccgtacgccgtacggacggggactaacggtaccgtaacggtaccgtaaccggtttacgaacctttaacgttacgtaacggttacggtaaaccggtacccggtaacgggtaccggaaaggggaaccgggtaaccgggtagggtaacccggtaacgttaacccgtttaaggtttaacccgttaaccgggttaaactaaacggttaacggtaacggaaccgttaagggttaacggtaacgggtttaaccgttacggttagggtttcggggggttaaccggtttaccgggggtaacggggtaacccggggaaacggttaacgggtaccggtaaccgggtttaccccgtacgggtttaacccggtaccgtaacccggaccccgggttaaacggtcccggttaccccgggtcccccgggtttaacccgg

SEQ ID NO: 201521 - DNA, 809 bp, Homo sapiens
  misc_feature: GYAE6OF01DWFLI.21.46.E02.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacagccaccctggtgtcagtcgtccccaggacagacggcaggatcactgctctgcagntcggactacgaccaaaagaaatagtcgtactttaagttacggtaaccaaacgaagaaacgacccgacgggaccgaaccgggtacccccttggttaggtttaggttagtaatttaagttaaagttaaaaacggaacctaacgttagggaacgtaccgggtaccccttagaaggtaaccgtaccgtaccccgtaggaacggtaccgttaacgtttccgttccggttacgggtccctacccgtacgtacccgtaacggaacggggactacggacgtacgtaccgtaacgtttacgaacttacgtacgtaaggtagtaacggtacccgaaggtacgaaaggtacggacgtaggacgtaagtaacttacttacgtacgtaaccgaaaacgtaggtaaacgtacgtaaagggttacgtaacggttacgttacggttagggttttaacggggttcggtacgggggaaccgggtaaacgggtaacccggaaacggttccggttaccggtaacccggttaccgggttaacccggtaacccgtaacccgggtaaccccggtaaccggtacccggttcccccggtccccccgtacccgggg

SEQ ID NO: 201522 - DNA, 639 bp, Homo sapiens
  misc_feature: GYAE6OF01A7YY8.21.46.E02.1.454.CMB.1.raw
  modified_base (405)..(405): a, c, t, g, unknown or other
  misc_feature (405)..(405): n is a, c, g, or t
  modified_base (478)..(478): a, c, t, g, unknown or other
  misc_feature (478)..(478): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtccagtcgtccccaggacacggacggccaggatccaccgtgctctgacgagatggactagaactaaaagaatatcgtacttagttacggtaaccaaacgagtaacgccgacggccgacggtaccccgtggtacgttagtagtataataagaaacgacacgtaggaacgacggcccctagaacgaacgactcccgtagacgtacgtacgttcctacgtcggtcccnccgacgtcgtacgaagggacagtcgacgtcgtagtctacgtgtacgtagtagacgtcgagaacgaggagacgnggactagtacttagtactagtaaccgaaagtacgtagtaacggtagtaggtaaccggttataggttggttagggtcggtcgggacggtaggaaccgagtccgtacggtacccgtacgtacggtcggaacccaccggtaccggtctcccggtccccgttacg

SEQ ID NO: 201523 - DNA, 282 bp, Homo sapiens
  misc_feature: GYAE6OF01ED5MQ.21.46.E02.1.454.CMB.1.raw
  modified_base (170)..(170): a, c, t, g, unknown or other
  misc_feature (170)..(170): n is a, c, g, or t
  modified_base (267)..(282): a, c, t, g, unknown or other
  misc_feature (267)..(282): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtccttcccctggcgccctgctccaggagccacctccgagngcacgaggccggcccgtgggctgccgtggtacaaggtaccttaccttcccgtcgtctctacgtggacggcgggtctgggacgaacggcgacaagtgnnnnnnnnnnnnnnnn

SEQ ID NO: 201524 - DNA, 609 bp, Homo sapiens
  misc_feature: GYAE6OF01BI1PY.21.46.E02.1.454.CMB.1.raw
  modified_base (244)..(244): a, c, t, g, unknown or other
  misc_feature (244)..(244): n is a, c, g, or t
  modified_base (292)..(292): a, c, t, g, unknown or other
  misc_feature (292)..(292): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgtnttaattggtaaccaacagaagcccgaaggccaggcccctgtcgttagngatatataaagacactagagaggccctagagacgatccctgacggcattctacgtcggctccagctacgaggacagcgtagtccgtaacgttgaacttagtcctaggttacgaacgtaccgaggtcaaggaggaccgaggtcgtagtacttagttcaggtaccaaacgtagtaacgactaaggtacgaaggttactacgtaaggttcgggtaggttaccggtacggaacgggaccgaacggttacgtacggtaacccggttcgtaacggttaccgtacggacccgtaaagggtccctaccgggtcccccgttaccgg

SEQ ID NO: 201525 - DNA, 780 bp, Homo sapiens
  misc_feature: GYAE6OF01E4OD7.21.46.E02.1.454.CMB.1.raw
  modified_base (261)..(261): a, c, t, g, unknown or other
  misc_feature (261)..(261): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctagacacacgccctacccgtcggtgtcacgtcgtacccaggacacggacggcgaggactccacctgctctgacagagtcggactagaaccaaaagtaaattntacgtactttagtacggtaaccaacgagaacgccgacggccgacggtccccgtggttagttagtacgaattaataagtaaacgactacgtgggaacgaccgcctagacgacgtacctccgaggacgtacgtacgtttcctacgtcggtacctccgtacgtccgtacggaacgggactacggtcgtacggttaccgtacgttacgtaacgttacgtagtaacgggtaacgtaccggacgtaagggacgaacgggaacggaccgggtaagcggttaacgtaacgttaacgttaaccttaacgtaaaccgtaaaggtacggttaaacgtaacggtacggttaaacgggttacgttaacgttacgggtttagggtttacgggggtcggttacgggggaccgggaaccgggtaaccggtacggtacccggttaacggtccccgggttaacgtacccgggtacccgtaaacccgggtaccccgaaccgggttcccccgttccccgggtcccccggtttacccggg

SEQ ID NO: 201526 - DNA, 719 bp, Homo sapiens
  misc_feature: GYAE6OF01A1ZYY.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagaccgccaggactcacctgctcgtgcagatggactgacaaagaatntgtcttatacggtaaccaacgagaacgccaggccacggtcccctgtcgttagtagatataataaagacactgagacgccctagacgagactcccgtagacgtcgtattcctcgtacggtcctaccgacgctacggaacggggacacggacgtaacgtcgtaccggttaggaacctttacgtaccggtaaaggttcgtaaacggttacccgaagggaaccggtaaagggacggggaacgtacgggtcgtaacgtaccgtttaacgttaacgtacgttaaacaaaacgttaacggtaaggaacgtaaacgggttagtaaacggtttactacggtttaacggtttaggggtccggttaccggggacgggaaccgggtaaccggtaacggtcccggtacggtaccccgttaacggttccgggaccccgtaacggacccccggtaaggtccccggtccccgggtccccccgtttaaccggg

SEQ ID NO: 201527 - DNA, 674 bp, Homo sapiens
  misc_feature: GYAE6OF01AWFEM.21.46.E02.1.454.CMB.1.raw
  modified_base (272)..(272): a, c, t, g, unknown or other
  misc_feature (272)..(272): n is a, c, g, or t
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagcccacccgtggtgtccaggtcgtccccaggacacgacggccaggatccaccgtgcctctcggacagagtcggactgaccaaaagaatactgcttagttcgtaaccaanaggaagccaggccaggcccctaggtgttagtacgtataactanaaacgtacacgtagagacggtaccagagacgatccgtagacgtcgaacttcgtacgtcggcctaccgtagtccgtaacggacggactacgggactacggtccctaaggttacgacttagtacgtacgtagaacgttacgacggacgtacgggaacggacgggtagacgtaacggtaactttaccgtaacggtttcaaaccgtaacgacggttaaggacgtaacgtaacggacgttacgtaacgtaggtttacgggtaggttcccggggacgacggggtaacctagggtactacggtacccggttcgtaacggtaccgaaccgggttccaacgggtacccgtcccgtaaccccggtccgg

SEQ ID NO: 201528 - DNA, 768 bp, Homo sapiens
  misc_feature: GYAE6OF01BE4KM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagctgacacacgcccacccgtcggtgtcagtcgtcccgaggacacgaccggccgaggactccacctgctacgtgacaggatcggactacgaaccaaaagtaatagtgtacttagttacggtaaccaagagaacgccgacggaccgacggtccctgttacgttagtagtactaataagtaaacgactaacgtaggaacggtaccggtaccctagaacggtaacgtacccgttacccgtagggaaccgtacgttacgtttccgtaccggtcggtaccctaccgacggtcctacgggaaccggacgagcgtacgtccgtacggttacgtaacgtacgtaccggaagttacggaaacggttcccggaaggaccggaaacggggtaacgggaccggtaagggttacctaacggtttaaactttaacggtttaccgtaacggtaaaccgtaaaggtaccggtaaagtaacgtaacggggtttaagaacggtttacgtaggttagggttcggggtacgggtaccggggcgggtaaggtaaccgtacgttaccgtaccgggtaccggtacgttacggaccgtaccgaccggtacggtcccgtacccggtccccgtaccg

SEQ ID NO: 201529 - DNA, 785 bp, Homo sapiens
  misc_feature: GYAE6OF01BZL0V.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctcccctcctcactctctgcacgaggctctgacggcctctatgagctagacacgacgcccacccgtcggtgtcacggtccgtacccgaaggacgacggaccggccgaaggtactacccaccgtcgccttcgtcgacgagtacgtcggaactcggaaaccgaaaaagtaaattagtacgttacttttacgttacgggtaaacccaaaacgaacggtaaccgccggtacggacccggaaccggtccccggttagggttacggtttacggtagtaaactttaacgttaaaacgtaaaacggtaacctaacggtagggaacggacccgggtacccgtaccgaacggaacgtaacccgttaccgtacggacgtaccgttacttccgtcgtcggtccctaacgcgtacgtacggaggaccaggtacgtacgtacgtacggttacggtaacttacgtacgtaacggtacggaacgtacccgaacggagtaagggacggtacggtacggttacgtacgtaacgttacgtaacgttacgaaacgtaagtaacggtaagaacgtagtaggtaacgttacgtagttacggttgggtacggtcgggacggaacggtacgacggtacgtacggtaaccgtcggtacggacccgacggacccgacgccggttcccgtcccggtaccgg

SEQ ID NO: 201530 - DNA, 852 bp, Homo sapiens
  misc_feature: GYAE6OF01AZUST.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgttcggtcgtcaggtccgtccccaggacacggaccggccaagggtactccaccgtgacctcgtcggcaggatggactcgaaccaaagtaaactagtgtactttagttacggtaaccaacgaggaacgtccgaacggcccgaaccggtccccgttaggttacggttaacggtagtaaatttaaacttaaacgttaaaacgacctaacgtaggaacggtaaccggtaccctaacgaacggtaaccgtaccgttacccgtaaggaccggtaccgttaacgttttccgtaccggtacggtacccgttaaccgacggtcccgttaaccgggaacggggtaacccgacggtaccgtaacgtttaccgtaccgggtttacgtaaccttacggtacggttaacgggttacggtaaaccggttacccggaaaggggtaccgaagggaaccgggtacgacgggtacctacggttaaccttacgtttacgtacgtaaacgtaaacgtcggtaagaacggtaagttaacggtaacggttaccttaagggttagggttcggggttaccgggtacgggacgggaaccgggtaacgtacggtacccggtacccggtaaaccgggttccggtaaacggcccgtaaaccggacccggtaaccggtccccgttacccgggtcccccggttaccggg

SEQ ID NO: 201531 - DNA, 756 bp, Homo sapiens
  misc_feature: GYAE6OF01A4REQ.21.46.E02.1.454.CMB.1.raw
  modified_base (418)..(418): a, c, t, g, unknown or other
  misc_feature (418)..(418): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagccaccgtcggtgtcaggtcgtaccccgaggacacggaccggccaagggactccaccttcggctacgtcgacagacgtacggactcgaaccgaaaagaaattgtacgttactttagtttaccgggtaaccaaacgtaacggaacgacccgaacggtaccggaacggtccccgttaggttacgtttaaggagttaactaagttaacgtaaacgaccgtagtacgacgtacggccctagagtacgtacctccggtanacggtctacttctacgcggtaccactacgtcgtacggaacggacacggctaacgcgttaacggtacgtacgtactacgacgttaacggtaacggtacgacggtacggaaaggtacggacgggtacgtaccgtacgaacgtttaacgttacgtaacgtaaacgtaacgtacggtaacgtaacgtaacgggttagtaaacgggtttactaccgggttagttcgggggtacggttacgggaccgggtaaacgggtacgtaacgtcggaaccgggttccgaccggtttacgggaccgtacccggacccggtaaggttccccgtcccggttacccgtacccgg

SEQ ID NO: 201532 - DNA, 873 bp, Homo sapiens
  misc_feature: GYAE6OF01CHYH2.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcacctctctgcacaggctctgaggcctcctatgagctgacacacgcccacccgtggtgtccagttccgtccccaggacaggaccggccaggactcacctgctctgcagatggactgaacaaagaatntagtacttagttacggtaaccaagaagaacgccgacggtccacggtccccgttggttacggttagtagtaagttaataacgtaaacgactacgtaggaacggtaaccgggtacccctagaacggtaacgtaaccgttccccgttaaggacggtaccgttacgtttaccgttacggttccgggtaccgttaccccgacggttacccgaaccgggtaacggggaccgtaacggtaacgtaccgttaccgtaacggtttacgaccgttaacgtacggtagggttaacgtaaaccggttaccgaacgggacgaaagggacgggtaacgggtaccgtacggtacgttaaccttaacgttaacgttaacggtaaacccgtaaagttaacggtaaacggtaacggaacgggtttaaacgggtaacgtttaaccggttacgttaacgggggtttacggggtttacgggggtttacccggggaaccgggggtaaacggttaaacccggtacggggttacccgttaaccggggttacccccgggttaacggttaacccgggtaccggtaacccggtaaacccccgggtaccgggttccccgttccccccgggtacccccggtttacccccggg

SEQ ID NO: 201533 - DNA, 781 bp, Homo sapiens
  misc_feature: GYAE6OF01BYLT0.21.46.E02.1.454.CMB.1.raw
  modified_base (163)..(163): a, c, t, g, unknown or other
  misc_feature (163)..(163): n is a, c, g, or t
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgacggcctcctatgagctgacncacgcctacccgtggtntcagttccgcccgaaggacacggacggccgtaggactaccnccttgcttgcgcaagtgtggactagaaacctaaaagtaatagtgtactttagtacggtaaccaacaaggaacgaccggacggaccgtacggtcccgttaggttaggttagtagtaataagttaaagtaaacgactaacgtacggaacggaaccggtcccgtaacgaagtaccgtaccgtccgtaagtaccggtacgtttactttccgtacgttccgggtacctacgacgtaccggttacggaaccggggacgtacgtacgtacgtaccgtacgttacgtaacctagttagtaacgtacggtacgtaacgaacggacggaaagggcggaacgggtgtaaccggtaagttaaccgttaagttaccgttaacgtaaacgtaaaggtaacggtaacgaacggttaaagggtacgtaacggtttacgtaggtttagggttccggggtagggttacccgggaaaggggtaaccggtaacggtacggttaccggtaccggtcccggttacgtaaccgggactaacccgggccgtaaccggtccccgtacccggttccccggtacccg

SEQ ID NO: 201534 - DNA, 838 bp, Homo sapiens
  misc_feature: GYAE6OF01BF9Y5.21.46.E02.1.454.CMB.1.raw
  modified_base (141)..(141): a, c, t, g, unknown or other
  misc_feature (141)..(141): n is a, c, g, or t
tcagtcgtcgctcgcacgaccggtgctcgatttagactcatctacagggaagggggtgggtccaggaggcagaactctgggtgtctcaccatggccctggatccctctacttctcccctcctcactcctctgcacaggctntgacgccctcctatgacgctgacacgacgccctaccgtcggtgtccgtacgtcggtacccccgaggaccacggacggccgaaggactccgaccgtcggccttcgaccgtacgaggtacgtacgggtaccctcgaaacctaaaaggtaaattacgttacggttacttttaaacggttaccgggtaaaccctaacggtaaccggtaaaaccgcccgggaaaccgggacccgttaacccgggtaccccgttttaggggttaccccgtttaaagggtaccgttaaagtaacggttaaaccgttaaaacggacctacgggtaaggtaccggtaacccgggtacccgttacgaaagtaccgggttaccttacccgggaggaaccggttcctaaacgtttcctacgggttccgtccgtaacctacggttacccgaacggtaacggtaacccgcgttaacctaggttaccgtaccggttagaacttacgtactaccggtagtaaccgtacggtacggaacgaggtacgacgttacggacgtactaacttcgtaacgttacgaacgtaaccgataccggaagtagtcgtaacgtcgttacgttggtccgggttaggtccgggagtaaacgggtaaccgtcggacgttacggtacccgtaccgttcggaaccgaccggtccgaaccgtctccccggccccggttaac

SEQ ID NO: 201535 - DNA, 609 bp, Homo sapiens
  misc_feature: GYAE6OF01ET2HJ.21.46.E02.1.454.CMB.1.raw
  modified_base (269)..(269): a, c, t, g, unknown or other
  misc_feature (269)..(269): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctgcagatggactcgaccaaaagaaatatgtactttagttacggtaaccaanagaacgccacggccacggcccctgtgttagtgatatataaagacatagagacgccctagagagactcccgtagacgcgtattcctcgtcgcctccagcctacggagggacagactagtcgtacgttacgactacgtcgagtacggtaacgtccgacgggtacaagggacggacggacggctacgtacttagttacgtagtaaccgaagtaagtacgtaacgagggtaacgtagttactagtaggttgggtacggttcgggacgggaacggaaccgacggtacgtacggtacccggtacgtacggaccgaccgaccgaaggccctcccggccccgtcccgg

SEQ ID NO: 201536 - DNA, 864 bp, Homo sapiens
  misc_feature: GYAE6OF01AC8ZH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttccctcccctcctcactctctgacacaggctctggacgtccctactagtgagtctgacacacgtccccacccgttcggtgtcgtacgtcccgtacccgaggaacgacggaccggaccggtaggactaccgtaccgtcgtccttacgtcggacgaagtacggtacggaaccaacgtaaaacccgaaaaagtaaatttacggttacgttaaccgttttaagggtttaaaccggtaaacctaaaacggaacggaaccgtaccggaaccgggtacccggtaaccccggttcccgttagggtttacggtttaaggtataacgttaaacgtttaaacgtaaacgaacccgttacggtaacggaaccggttacccggaccccgtagaaccggaaacgtacccgtaccggaggtaccggttacgttaccctttccggtcggtccgtaccccgacggtaccgacggtaacggacggaacctcggaccgtacgttaccgtgttaacgtactacgtacgtacggtacgaccgtacgaggacgaggaggacggacgtagtacgtacttacgtacgtaactaacgaacgtaggtaacgaacgtaacggtaaggttaacgttaggttaacggtttacgggtacgggtttaccgggcggggtaaaccgggtacggaaacccggtggtaccggtaccggttccggtaacccggtaggtacccgaacccgggtacggacccggtaacccgtccccgtcccgttaccccgg

SEQ ID NO: 201537 - DNA, 1199 bp, Homo sapiens
  misc_feature: GYAE6OF01DOVFI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgacggcctctatgagtctagaccacgacgccctacccgttgggtcgtcgtacggttccgtaccccgaagggaccgaacgggaaccgggtccaaagggtactacccgaaccgtttcggacctttcgacggacgtaaggtacgttacgggaaccttacggaaaaccgtaaaaaaggtaaaactttgttacggttaaccgtttttaaacggtttaaccgggtaaacccgaaaacgaaacggaaaccgggacccgtaaccggggacccggtaacccgggttcccccgtttagggttacggttttaaggtaacgtaaagttttaaacgtaaaaacgttaaacggaaccgtaaacgggtacgggtaaaccgggtaccggtaccccgttacggaaaacggtaccggttaacccgttacccgggtaagggtaaccggttaccgggtttaaacttttcccggttacgggtttaccgggttacccctaacccgggtaaaccggtttcccgggtaacggggtaaaccggggaaaccgtacgggttaacccggtaaccggtttaccgtttaaaccggggtttaacgtaacctttaaccggtaacggtaacgggtttaaacgggaaaccgggttacccgggtaaacgggaaccgggtaaacggggaaaaccggggtacgggttaaaccgggttaccggtttaaaccggttaaccggtttttaaccgtttaaaccggttaaaacggtaaaaccgttaaaaacggggttaaacggtaaaacgggttaaacgggttaaaccgggtttaaacgggttaaaccgggttttaaaccggttaacggggtttttacggggggtttaaacccgggggtttaccggggggttaaaccggggtaaaacccgggggggtaaaacgggttaaaccccggggtttaaaccggtttaccccgggggttaaacccggtttaaaccccgggggttttaacccgggtaaacggggtttacccccggaaaacccggggttacccccgttaaaaccggggtccccccggttttaaaccccggggtcccccc

SEQ ID NO: 201538 - DNA, 853 bp, Homo sapiens
  misc_feature: GYAE6OF01B7JL3.21.46.E02.1.454.CMB.1.raw
  modified_base (265)..(265): a, c, t, g, unknown or other
  misc_feature (265)..(265): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggccctcctatgagctgacacacgccctacccgtcggtgtcacgtcgtaccccgaggacacggacggccaggactccacctgcctcgtgacagtacgtcggactcgaaccaaaagtaatntgtactttagttacggtaaccaaagtaacgaacggcccgacggacccggtaccggtcccctttaggttaggtttaacggtagtaattaataaacgtaaaacgacctacgtcggaaccggacggtccccttaagaacggtacgtacctccgtaggtacggtacgttacttccgtcggtcggtaccctaccgtaggtccctaaggacgggtaaccgacggaccgttaggttcccgtaacgtttacggttaacctagtccggttaaggtacgtaaaccgggttaccgaacgggttaaccggaacgggtaacgggaaccgggtacgtaccgtttacgtaaaccgtttaagttaccggtaacgtaaaccgtaaacggaacggtttaacgaaccggttagtaacggggttaactaccggttaaggtttacggggtttcggggttaccgggttaaccggggaccgggaaaaccggggttaccgaacgggtttacccgggtaccccgggttaaccgggttaccgggttaccggtacccgaaacccggggttaccccgtaacggggcccctttaaccccgggtcccccgttacccgg

SEQ ID NO: 201539 - DNA, 702 bp, Homo sapiens
  misc_feature: GYAE6OF01A80DG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaatatcgacttattggtaccaactagaaacgccaggcccaaggccccctaggttgttagtgatatactaaagacactgagacggcctacgagacgactcccgtagacgcgtaacttcgtcgtggtccgtaccgtaagcctcgaacggggaccaggcctaacggtcacggtttacgacgttacgtcctaaggtacggaaacgttccgtaaggaccgtaaggacgggtaacggagggtaccgttaggtaacttaacgttaaccgttagtaaccgtaaacgtaacggtaacggtaaccgaaggggtttaaccgaggttaaaccgttaccggtagtttcgggggtttacggttacgggggaccgggtaacggggaaccgtaaacggaccggtttaccgggaacccggtttacccgtagggtacccggaacgccccggtaaacgggtccttcccgggcccccgttacccggg

SEQ ID NO: 201540 - DNA, 695 bp, Homo sapiens
  misc_feature: GYAE6OF01B84G7.21.46.E02.1.454.CMB.1.raw
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactccacctgctctgcagatggacctgaccaaaagaaactatgtactttattaggtaaccaaacaagaacgaccgacggaccacggccccctggtagttacgngtaatataataagacactgagacgccctcagagactcctgagacgtacttcctagtcgcctccgacgcgtacgagggacagactagtcctacgtnactatacgtagtagaacgtaccgaggacgaacggtagggacgtacggtcgtaacgtacttaacgtttacgtacgtaaccaaacgtagtaacggtaacgtaaggttacggtaacgttacgtacgtacggttttggggtacgggtttaccggggaccgggtaaaggggtaaccccgtaacgggtacccggttaaccgggttaaccccggtaccggttaaccgggtacccggtaaccggtaaccccccgggtaaggtccccgtttaccccggacccccccgggtttaccccggg

SEQ ID NO: 201541 - DNA, 681 bp, Homo sapiens
  misc_feature: GYAE6OF01A5A6Z.21.46.E02.1.454.CMB.1.raw
  modified_base (177)..(177): a, c, t, g, unknown or other
  misc_feature (177)..(177): n is a, c, g, or t
  modified_base (354)..(354): a, c, t, g, unknown or other
  misc_feature (354)..(354): n is a, c, g, or t
  modified_base (446)..(446): a, c, t, g, unknown or other
  misc_feature (446)..(446): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcagagctctgacgcctctatgagctgacacacgcccaccgtggtntcagtcgtcccgaggacacggcgcaggctccaccgtgctcgtgcagtacgtcggaactacggaaacctaaaaaggtaattacgtacgttaacgtttaacgttaccggaaaccaaacgaacgaaccggtaccgtaccggaccgtaccggtccgtgttacggtagtagtaataactaanaacggacctaggtaggacggtcgaccgtgacggaacaccttaccgagacgtacgtacgttcgtcgtccgtctaccgagtaccaggtacgacngtcgtagtacgtacgtcgactacgacgtagtacgacgtcggaagagacggtacgacggtatacgtagtaacgttagtaacgtaacggtaaccaagtaacggtacgtaaggacgttaagtccggttaacttgggacggtttgggaccggggttacgacgggaaaccgtacgaggttcgtaccggtaccgttacgacgtaaccggcgtaaccgccgggacctccccggtccggtacg

SEQ ID NO: 201542 - DNA, 745 bp, Homo sapiens
  misc_feature: GYAE6OF01BT3X9.21.46.E02.1.454.CMB.1.raw
  modified_base (245)..(245): a, c, t, g, unknown or other
  misc_feature (245)..(245): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatccacctgctctgcagatggactgaccaaagaaatntgtcttattggtaaccaacagaagccaaggccacggcccctgtgttagtgatataataaagacacgtgagcggccctanagagactcccgngacgcgtattccgtcgtcggcctccacggtcctacggaacgggtacgacgacgtaagttcctaacggtttgaaccttataccgaaggttcggtaaacgtcccgaaggtacgaaggtaacgggacggtacggtaccgttagtaactttagttaccgtaagttaaccgaaacgtaagtaacggtaaccgtaagggttaacggtaacggttacccgttacgttaagggttcggggtttaaccggttccgggggtaccggggtaaccgggtaaaccggtaacgggttccccgttaacgggtaacccccgggtttacccggttaaaccgggtacccggtaacccgggtaaacccccgggtaaaccgggttccccggtttaccccccgggtccccccgggttttaacccccgggg

SEQ ID NO: 201543 - DNA, 677 bp, Homo sapiens
  misc_feature: GYAE6OF01AHEDR.21.46.E02.1.454.CMB.1.raw
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
  modified_base (552)..(552): a, c, t, g, unknown or other
  misc_feature (552)..(552): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctggtgtcagtcgtccccaggacagaccggccaggatcacctgcctctgcagatggactgaccaaagaatatgtcttagttacggtaaccaacgagaacgccgacggccacggccctgtagttagtnataataataagacagtagagcgccctagagtacgactccgnggactacgtactttcgtcgtcggcctacgacgtccgtacgaacgggactaggcctacggtaccgtaacgtttgaaccgttatacggaagttacgtaacgtacccgaagggtacgaagggacgggaccgacggttacctagttaaccttaacgttccggtaacgaaacctaacggacgtaacgtaacgtaagggtaacgtacgttaacgttnttacggggttgggttccggtacgggacccggtaagggacccgtaggtcccggttaacccggtccggtaccggtaaggtacccgaacggacccccggtaagtcccgttaccccggtccccgtacgg

SEQ ID NO: 201544 - DNA, 716 bp, Homo sapiens
  misc_feature: GYAE6OF01DURW0.21.46.E02.1.454.CMB.1.raw
  modified_base (240)..(240): a, c, t, g, unknown or other
  misc_feature (240)..(240): n is a, c, g, or t
  modified_base (333)..(333): a, c, t, g, unknown or other
  misc_feature (333)..(333): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtcccaggacagacggccaggatcacctgctctgcagatggactgaccaaagaaatntgtactttattacggtaaccaacgagaacgccgaggaccacggcccctgtagttagtgtaattataataaagacacgtggacgacggaccctnaagagtactccgagacgtcgtacttcgtcgtggcctcgacgtccgtacggacgggacacgtacgtacggttacgtaacggtttacgtaacttacgttcgtaaggttacggaaacggttacccggaagggacggaaacgggggaacggtacgggtaacggtccgttaacgttaacgtttacgttaacggttaacgtaaaccgtaaagtaaacggtaaccggtaaacggtaacggttacggttaacgttaacgttaacggttagggtttagggttaccggggtacgggaacgggtacggtaacgtacggtacccggttaccgtcccggttaacggtcgaacccgtcccgaaccgtaccggtcccgttccccgtcccggttacccg

SEQ ID NO: 201545 - DNA, 690 bp, Homo sapiens
  misc_feature: GYAE6OF01BZVD8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatccacctgctcgtgcagatggactgaaccaaaagtaaatatggtacttattacggtaaccaacgagaacgccgaggccgacggtcccctggtagttagagtataagtaagtaaacgactacgtaggacgacggtacctacgaacgacgtactacccgtaggacgtacgtacttccgtcgtacggcctacgacgtctacgaacgggtacacgtacgtacggttacgacgttagtaacgtagtacgtagtacgtaacgtacccggaaggacgaacgggtacggacgtacgggtctacgtaacgttagttaaccgtaggtaacaacgtaaggtaacgaacgtaaggttaacggtagttacgttacgtaggtttggggtacgttacggggacgggtaaccgggacgtaacggtccgtaacggttcccgtaccgttaacggtaccgaacggacccgtaacggtcccctaccggtcccccggtaaccgg

SEQ ID NO: 201546 - DNA, 729 bp, Homo sapiens
  misc_feature: GYAE6OF01AJP99.21.46.E02.1.454.CMB.1.raw
  modified_base (259)..(259): a, c, t, g, unknown or other
  misc_feature (259)..(259): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgcccacccgtcggtgtcagtcgtccccgaggacaggaccggccagggactcctacccgtgctcgtgcagactggactacgaccaaaagaaactntgtcttaagttacggtaaccaacagaacgcgacggaccacggtccctgtcgttagtgatatactaaagacacgtagacgacggtccctagagacgacctccgtagacgtcgtactttcgtcgtacgccgttaccgacgtccacggtagggacctacggaccgtaacgttaccgtaccggtttacgaccttaacggtactaaggggttacgtaaccggttacccgagggtaacccgtagggaacggaccggtacgggtacgttacgtaaaccgtttacgtttaacgtcgtaaaccgaaaagtcggtaaggaaaccgtaggttaaccggtaagttacccgtagttagggttcgggttacgggccggtaacggaacgggtaaccgtaggttccggtaccggtaacccggttacgtaacgggtaccgtacccggtacccggaagggttccccgtcccgtcccccggtacccggg

SEQ ID NO: 201547 - DNA, 830 bp, Homo sapiens
  misc_feature: GYAE6OF01CGYQG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagctgacacacgcccacccgtcggtgtcagtcgtcccaggacacgacggccgagactcacctgctcgtgacgagagtcggactacgaaccgaaaaagtaatatagtactttaagttacggtaaaccaaacgaaggaacgccgaacggaccggtaccggtccccgttaggttaggttagtagtaatttaaataaacgtaaacggtaaccgtacgtaaggaacggtaccgtacccgttaacgaacgaacgtacctacccgtacggagtaccgtactttcgtacgtacggtcctacgtacgaccgtaggaacggacacggacgtacggtactaacggttactacgttacgtacggtacgtacggaaccgtaccggaagggacgaagggtaacgggacggtacggttcgtaacggtaactttacgttaacgtacggtaaacctaaaacggtaaggaacggtaaacgtaagggttaacggtaaccggttaacgttaacggttacggggtttaacggggttcggggttacccggggaaacggggtaaccggtaaacccgggtaacggacggtttaaccccggtaacccggtttaccgggtaaaccgggtaacccgtaaccggggaaccccgtaaaccgggttccccggttacccccggtaccccccggtttaaccgggg

SEQ ID NO: 201548 - DNA, 821 bp, Homo sapiens
  misc_feature: GYAE6OF01B1VPD.21.46.E02.1.454.CMB.1.raw
  modified_base (84)..(84): a, c, t, g, unknown or other
  misc_feature (84)..(84): n is a, c, g, or t
  modified_base (168)..(168): a, c, t, g, unknown or other
  misc_feature (168)..(168): n is a, c, g, or t
  modified_base (545)..(545): a, c, t, g, unknown or other
  misc_feature (545)..(545): n is a, c, g, or t
  modified_base (608)..(608): a, c, t, g, unknown or other
  misc_feature (608)..(608): n is a, c, g, or t
tcagtcgtcgctcgcacgaccggtgctcgatttagactcatctacagggaaagggggtgggtccaggaggcagaactctgggtntctcaccatggcctggatccctctacttcctcccctcctcactctctgcacaggcttctgacggccctctatgagctagacacncgcccacccgtcggtcgtcgtaggtccgtccccgaagggaccacggaccggccaggtactccaccgttgtcctcgtacgactacgacgtcggtaacctacgaaaccgtaaagtaaacttacgttacgttaacgtttacggttaccggtaaaccaaacggaacggaacggtcccgaacggacccggtacccggtaccccttggtacggtttaacggtagtaactttaagttaaacgttaaacggaccttaaggacgggaaccggtacccgtacccgtaagaacggtacgtaccgttacccgaggtaccgtaccgttacttccgttacggtccggtacctaccggacggtaccgacgggtaacggacctacggttaacnccggttacgtagttacgtaactcgtacgaggtaccgacgtacgaggtagacgggacggtacgnggtactacgtacgtttacgtaacgttacgtaacgaaaggttacgtaacaacgggtagtaacggttaaccgtacttgggtttaacgggtcgggttcgggttacccggggaccgggtaacgaaccgtgggttacccggttaccggttccggaccgttacggacccggtaccggtacccgggtagtccccggttaaccgggtcccctttaaccggg

SEQ ID NO: 201549 - DNA, 858 bp, Homo sapiens
  misc_feature: GYAE6OF01D85CQ.21.46.E02.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactttctgcacagtctctgacggcctctatgacgctgacacacgcccacccgtggtntcgagtcgtaccccgaggaaccaacggccgaaggactccacctgcctacgtggatacttctagttacgaaacctaaaagtaacttagttaacgtttggtttacggtaccagacgaagtaacgtcgacggccgaccgtccctggtactggtactctaccagtcggacggtccgaggtaccgaccgtaccgaccggtccgggtactcccgtaggacgtacgtactttcccgtacctccggtaccctcgtaccgtcgtaccggaacgggtaccgtacggtccggtacccttacgtacgtaaccgtcgtaccggtaccggggttaccggggaccgtacggggtaacggacggtacgttacggaacgttccggttaacgttaacctttaacggtttacgtttacccggttaaccgacgttaacccggaacgttaacggtacgtttacgggttcgtaagtaccggttcgggggtaaaggggttcccggtaccgggggaacgggttacccggtaacgggtttaaccgggttcccggttacccggtttaccggttaccgggtaacccggtacccgggtacccgtaaccggggttccccggtacccccggttaccccccgtcgggttaccccttacccggtttccccgtttaaccccccggttcccccttccccggtttacccccg

SEQ ID NO: 201550 - DNA, 781 bp, Homo sapiens
  misc_feature: GYAE6OF01DQ9M5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctggacggtcccttcctagtgagctagacacgacgcccacccgttggtcgtcagtccgtacccgaggaccgacggacggccagggactcaccgtgctcgtgcagagtcggactcgaacaaagaaactgtcgtactttagttacggtaaccaacgtaagaaccgccgacggccgaaccggttccccgtaggttaggtttaacgtaggtaacttaaagttaaaacgtaaaacggtaccgtacgtacggaacggtaccgggtcccttacgaagtaacgtccgtacccgtaggacgcgttactttccgtcgttacggccttaccgacgtcgtacggaacgggtcacggacgtacgttaccgtacgttacgaacttacgacgtaaggttacgaacgtaccgacggtaacgaagggcggaacgacggttcgtaagtaacttacttacggtaacgtaaccaaagtaacggtaacggacgttagggtaacggtaacgtttcgtaacgttagggttttcgggtaacgggtccggtaaacgggaccgggtaaccgttacgggtaccgtaccggttacccgtacgggtaacgttacccgaaaccggggtacccctaagggtccccttccccggggtcccccgtttacccggg

SEQ ID NO: 201551 - DNA, 650 bp, Homo sapiens
  misc_feature: GYAE6OF01DCE8R.21.46.E02.1.454.CMB.1.raw
  modified_base (635)..(635): a, c, t, g, unknown or other
  misc_feature (635)..(635): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcacctctctgcacaggctctgaggcctcctatgagctgacacagcccaccctcggtgtcagtcgtccccaggaccaggaccggccaggactccacctgctctgcagatggactgaccaaaagaatatgtactttagttcggtaaccaacgagaacgccgacggccgacggtccccttaggttcgttacggtagtaactaataagtaaacgacacgtaggacgtacggccctagacgacgtactaccgtagacgtacgtatttcctacgttcgccttcgacgtcctacggaacggacgacgtcgtacgttacgtacggttagtaacttagtaccgtaagtacgtaacgtacgaggacgaaggacggaacgacggtctacgtacgttacgttacgacttaacaagtaacgtaacgtacgaaggtacgtacgtacttacgtaggttcgggtacggtcgacggggtacgacgtacgacgtacggtaccgtacgttagaccgtacgccgtacgtccncccgtcccgtacccg

SEQ ID NO: 201552 - DNA, 780 bp, Homo sapiens
  misc_feature: GYAE6OF01AID94.21.46.E02.1.454.CMB.1.raw
tcagtcgtcgctcgcacgaccggtgctcgatttagactcatctacaggggaaagggggtgggtccaggaggcagaactctgggtgtctcaccatggcctggactccctctacttctcccctctcactctctgcacgaggctctgacggtcctctatgagctagaccacacgccctaccgtggtgtcaggtccgtacccaggacgacggaccggaccaaggactccaccgtgcctcgtggacagtcgtacggacctacgaaccgaaaaggtaaacttcgtacgttactttaagtttaccgggaaaccctaaaggacggaaccgccggtaccgggaccgaccggttcccgtggtttacggttacgtaggtaacttaagtaaacgtaaaccggtacctaacggtcgggaaccggtaccggtaccccgtacgaaggtaccggttaaccgttccggtaagggaacgttaccggttaccttaccgggtccgttacggcccgttacgaacgtcgtaaccggacggactacgggtactaccggtacgtacggttacgtaacttacgtacggtacgtacggacgtacggacggacggacggaacggacggacgtcgaacgttacgttacgtaacgactaaccgaagtactaaggactacggtacggtacgtacgtacgtacgggttgggtaccggttaggacgggtaaccgacgtaccggcgtaccggtccgtacggtaccgacgtacccggacggtaacggtcccgttaccccggtccggttaccccg

SEQ ID NO: 201553 - DNA, 653 bp, Homo sapiens
  misc_feature: GYAE6OF01CEJFQ.21.46.E02.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggaccagacggccagggactcacctgctctgcagatggactggaccaaaggaaatntgtactttagttacggtaaccaaacgaacgaaacgaccgaacggcccaacgggtccccccttaggttacggtttagtaggtaattaattaaagttaaaacggaacctaaccgttaggaacggaacggcccttacgacggaacgtactccccgtagacgacgtacttcgtcgtcggcctccgagtcgtcgaacgggacagtacgacgtctacggttacacgtacgtacgacgtagaacgtaccgaaggtcgaaggacggacggaggtactagtaacttaagtacgtagtaacaaagtagtaagacggtaagtagtacgtatacgtagttgggtcgttcgggacggaggacgaaggtctacggccgtacgtacggtaccgacgaccgaacggctccggtcccgtaccgg

SEQ ID NO: 201554 - DNA, 876 bp, Homo sapiens
  misc_feature: GYAE6OF01CZFY1.21.46.E02.1.454.CMB.1.raw
  modified_base (296)..(296): a, c, t, g, unknown or other
  misc_feature (296)..(296): n is a, c, g, or t
tcagtcgtcgctcgcacgaccggtgctcgatttagactcatctacagggaaagggggtggtccaggaggcagaactctgggtgtctcaccatggcctggatccctctacttcctccccctcctcactctctgcacaggctcgtgacggccctacctagtgacgctcgacaccagccctacccgtggtcgtacgtacgttccgtaccccgaggaccaggaccggcctaggactcccgaccgtgtcctcgtcgaccgaaggtacgtacgggtaacctacggaaacctaaaagtaaatnttacgtaccgtttaagtttaccggaaccctaaagacggtaaccgacccgacggacccgaccggtccccttaggttaggtagtacgtaatttaacgtaaactaacgcgacgtacggacgtaccggcctacgaacggtacgtactccggtagacgtcgttacgtttctacggtcgaccgtccgtacgtaccgtacgggaacgacgtacggacgtacgttaccggtacttacgtaacgttacgtacggtaacgggttacggtaccggtaacgtaacgggacggtaacggggacgggtacggtaaacgggttcgtaaacgttaaccgtttacggtttaaccgtacgtttaaaacccgaaggttaaacggtaaccggtaaacgtttaacgggtaacggttacgtaacggttcggtttaacggggttacggggttttaaccgggaacccggggtacggggtaacccggtaaccggtaaccgggtaccttcccggggtttaaaccccggcgggttaacccgaacccggtaacccgggaaacccggtttccggtcccccgggtaccccggtcccccgtttaacccggg

SEQ ID NO: 201555 - DNA, 882 bp, Homo sapiens
  misc_feature: GYAE6OF01BPHCB.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctagacacacgcccacccgtcggtcgtcacgtcgtccccaaggaccacggaccggaccaggactccaccgtgctctgcagatacggactacgaaccaaaagtaaatgtcgtactttaagttacggtaaacccaaagaacggaaacgacccgaacgggtacccgaccgggtacccccgttagggtttacggtttaggttacggtaatttaaacgttaaaacgttaaaaacgaacctaacggttaacgggaacgggtaaccggtaccccttaaggaacggaacgtacccttaccccgtagggaaccggtaccgttaaccgtttccgtacggttccgggtaccctacccgtaacgggtccgtaacggacgggggaaactacggaccgtaacggttacgtacgggttacgtaaccgttaagtacgtaacggtacggtaacggttaccgaacgggtaaccgaagggtacgggtaaccgggtaacgggtaccgttaacgttaaccgttaacgtttaaaccgtaacggttaaacctaaacgggttaacggtaacggtaaccggtaaagggtaaccgggttaacggttaccgttaacggttacggggttagggttacgggtaccgggtaacggggtaaccgggtacccggtaaaggtcccggtaccgggtaccggttaccgtaacgggtaccgaccggtacccgacggtcccctccggtcccccggtaccgg

SEQ ID NO: 201556 - DNA, 722 bp, Homo sapiens
  misc_feature: GYAE6OF01AMWL0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggtcctcctatgagctgacacacgccacccgtcggtgtcagtcgtccccaggacacgacggcaggactccacctgctctgcagatggactacgaccaaaagaatatgtacttatacggtaccaagagaacgccacggccacggccccgtgttacgtagtagaattataaagaaacgtactacgtaggacgaccggtccctacgaaggactactcccgtaggacgtaccgtatttccgtcgtcggtcctaccgacggtctacggacggaccaggacgtacgttccgtaacgtgtaacttactacgaacggttacgtaacgtcccggaaggacgaaagggaccggaacgggtacggtaacttacgtaaacgttaccgtttacgtaacgtaacgaaaacgtacggttaacgaaggtaacgggttaacgtacggttacctaggttagggttacggggtttcgggtaccggggtaaaccgggtaacggacccggtaccggtacgttaccggtaccccgtttaccggaggtaacccctacccgggacccggtaccgccccgttcccgtacccccggttacccgg

SEQ ID NO: 201557 - DNA, 678 bp, Homo sapiens
  misc_feature: GYAE6OF01DHS82.21.46.E02.1.454.CMB.1.raw
  modified_base (216)..(216): a, c, t, g, unknown or other
  misc_feature (216)..(216): n is a, c, g, or t
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacagcccaccctcggtgtcagtcgtcccaggcagacggccaggatcacctgctcngcagatggactgaaccaaaagaaactntgtctttaattcggtaaccaacaagaacgccgaggccacggcccctagtcgttagttgataataagtaaacgacacgttagagacggccctacgaacggaagtacctaccccgtaggacgtcgtacgtttccgtcgtacggccctccgacgtccgttcggaacgggactacggacgtagtaccgtacggtttacgtaacttacgttaccgaggtacggtaaacgtccgtaggacgtaacggaggacggaggtcctaagtaccgtttattacgtactaacaaacgtaggtacgaacgtaaggtaggtacgttaacgtcgttagggttgggttacggtacgggaggggtaaacggacgtaacggtccgtggttaacccccgtaggttacggtacccgacggtaccccgaaggttcccgcccggtcccccgttaccgg

SEQ ID NO: 201558 - DNA, 877 bp, Homo sapiens
  misc_feature: GYAE6OF01D4UHB.21.46.E02.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacagcccacccgtggtntcagtcgtccccaggacacgaccggccaggactcacctgcctctgcagatggactgaaccaaaagaactagtgtacttagttacggtaaccaacgaggaacgccgaaggcctacggtccccttaggtacgttaggtacgtaattaagtaacgttaaaacgacctaaccgtaggaacggtaccggtaccccttagaacgtacgttaccgtacccgtaggaacgtaccggttactttccgtacggtaccggccttaccgaacggtcctaaccggaagggaacccaggtaccgtaacgttaccggttaacggttacggaacctttaagtaccggtaacggttaacggtaaccggttaccggaacgggaccgaaggggtaaccgggaaccgggtacggttacttaacgggtaacctttaaggtttaccgtaacggttaaacaacggtacggttaaacgaaccggtttaagggtaacccggtaacggtttacgttaccggttaaggggttttcgggggttaaccggttaccgggggaacggggtaaaccggggtacccgtaaacggggttaccccggtaaaccgggtttccccccgggttaaacggttaaacgggggtaccccggtaaacccgggttacccccggggtaaaccgggttttcccccgggtaccccccgggtttaacccccccgggttttcccggg

SEQ ID NO: 201559 - DNA, 892 bp, Homo sapiens
  misc_feature: GYAE6OF01CUXZ1.21.46.E02.1.454.CMB.1.raw
  modified_base (161)..(161): a, c, t, g, unknown or other
  misc_feature (161)..(161): n is a, c, g, or t
  modified_base (261)..(261): a, c, t, g, unknown or other
  misc_feature (261)..(261): n is a, c, g, or t
tcagtcgtcgctcgcacgaccggtgctcgatttagactcatctacagggaaagggggtgggtccaggaggcagaactctgggtgtctcaccatggcctggactccctctacttctccccctctcactctctgcacgaggctcgtgacggcccttctatganctagacacacgccctacccgtggtgtcagtccgcccaggacacggaccgccaggactccacgtgctcgtgcagagtcgacctcgaaaccgaaagaaattntacgtagtttaacgttacggtaaacccaacgaacggaaaccgccggaaccggaccggtacccggttacccccggtaggtttacgtttaggtacgtaagttaacgttaaaacaaacgtaaccgaacggttaacggaacggtaacccggtacccgtacgaaacgggtaaccgtacccgttacccggacgtaacgtaccggtttacttaccgttacgtccgggtaacccttccgaacggtaccgtacggaccggacgtcgacgtaacggtcgtaacgttacgacttacgtacggtagacggtaacgtacggaccgggaacaagggtacgggaacggtacgaacgtttaacgtaccttaagtttaccgaaccggtaaacctaaggtaacgttaacgggtaaccggtaagggttaaacccggtaagtttaccgggtacgttttacggggttagggggttacccgggttaaccgggggtaaccgggtaaaccggggtaaccggtaaaccggggttacgggtttaaccccggttaaccggggtaaccccgggttttaacgggacccccgtaaccggggaaacccccggttcgggttaacccccggtttcccccgggttaaccccccgtttacccgggg

SEQ ID NO: 201560 - DNA, 777 bp, Homo sapiens
  misc_feature: GYAE6OF01BYG6H.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgcagatggactacgaccaaaagaaatatgtactttaagttacggtaacccaaacgaaggaaacgacccgacgggacccgaaccggtccccccgttggttacgtttaaggtagtaaagttaagttaaaagtaaaaagaccgtaacgttaggaaacggtaaccgggtacccccttaagaaacggtaacggtaaccttacccccgtaggaaccggtacgtaactttccgtccgtcgggtacccttacccgaacgtccgtaccggaaggggacctacgacgtaacgtccgtacgttacgtaacttacgtacgaggtacgtaacgtacccgaaggcgtaagggacggaacggagggtacctacggtaacttagtttaaccgttacgtaaccgaaaacgtaggtaaacgacgtaagggtaacggaacgttacgtacgttaggttggggttacggtacggggtacggaaccgggtaacgtaacgggtcgtaacccggtccggtaccgtacgggaccgtaacccgacccggtaaccggtcccgtccccgtaccccccggttccgg

SEQ ID NO: 201561 - DNA, 865 bp, Homo sapiens
  misc_feature: GYAE6OF01CZPPU.21.46.E02.1.454.CMB.1.raw
  modified_base (129)..(129): a, c, t, g, unknown or other
  misc_feature (129)..(129): n is a, c, g, or t
  modified_base (215)..(215): a, c, t, g, unknown or other
  misc_feature (215)..(215): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactcnctgcacaggctctgacggcctcctatgacgctagacacacgcccacccgtcggtgtcagtcgtcccgaggacagacggccaggacncacctgctctgacagagtggactggaaccaaaagaactatgactttagttacggaaccaaacgagaacgccgacggacccgtacggtccccttaggttggttaagtacggttaacgtaaagtttaaaacgaaacgtacctaaggacggaacggtaccggtaccccttagaacggaacgttaccgtaccccgtagaacggttaccgttactttcccgtcggtccggtaccttaccgacggtaccgtacggaacgggaccgaacgtccggtaaagttcccgtaacggtttaagtaaccgtttaacgtacccgggttaaggtaacgggtaacccgtaccccgggtaagggaccggttaaagggaaccgggttaccggaacgggtttaaccgttacggtaaacgtttaacgttttaacccgggaacgttaaaaccgtaaaacggttacgggaaaccgttaacggaaaacggtttaacggggtaaccgggtttaacttacggggtttacggtttacgggggtttaccggttaccgggaaacggttaaccggggaaacgttaacggtacggttacccggtaacccgggttacgttaacgggccgttaaacccggacccggttaaccggcccgttccccgggtacccccgttacggg

SEQ ID NO: 201562 - DNA, 757 bp, Homo sapiens
  misc_feature: GYAE6OF01CVECB.21.46.E02.1.454.CMB.1.raw
  modified_base (171)..(171): a, c, t, g, unknown or other
  misc_feature (171)..(171): n is a, c, g, or t
  modified_base (738)..(738): a, c, t, g, unknown or other
  misc_feature (738)..(738): n is a, c, g, or t
tcagtcgtcgctcgcacgaccggtgctcgatttagactcatctacaggggaaagggggtgggtccaggaggcagaactctgggtgtctcaccatggcctggactccctctacttcctccccctcctcactctctgcacgagctctgacggtcctactatgagctagacacncgccctacccgtggtcgtcaggtccgtacccgaggaccacggacggaccaggtactccaccgtgcctacgtggacaaggtacgtcggactacggaaactaaaagtaattctgtacttacgttacgaacaacgacgaaccgacgacggaccgccggtaccgtagttacggttagagtaacttaacgtaaacaaacgactacggtaagacggtacgcctagacgtacgtcctaccgagacgtccgttacttccgtcgtcgtacctaccgcgtcgtacggaacggaccagaccgttacgtaccggtagttcgtaacgtagtacgtaggtaacgaaccggttacgacggtaacgtaaacgggcgggtaacgaccggttactaacggtacttaccgttaacgtaacgtaaacgtaacgtaaagacggtaagtaaacggggttcgtaacgtttacgtaggtttacggggttacggggttacgggtaaccgggtaccggggaattaccggtaccgtaccggtacggttacccgggtacgtaccgggtactcccgggaaacgtcccgggttaccnccccgttaccggttacccg

SEQ ID NO: 201563 - DNA, 765 bp, Homo sapiens
  misc_feature: GYAE6OF01D99XM.21.46.E02.1.454.CMB.1.raw
  modified_base (167)..(167): a, c, t, g, unknown or other
  misc_feature (167)..(167): n is a, c, g, or t
  modified_base (559)..(559): a, c, t, g, unknown or other
  misc_feature (559)..(559): n is a, c, g, or t
tcagtcgtcgctcgcacgaccggtgctcgatttagactcatctacagggaaagggggtgggtccaggaggcagaactctgggtgtctcaccatggcctggatccctctacttcctcccctctcactctctgcacgacggctctggacgcctctatgacgctgacacngccctaccgtggtgtcagtccgtcccgaggacacggaccggctaggactccaccgtgcctactggacgagtacgtacggactacgaacctaaaagaacttgtacgtactttagttacggtaacgaacgtaacgacgtaccgacggaccgaccgttccccgttgtagttacggtagtaataacgttaacgaaagtaccgtagtacggacgtacccggtacccgtagtaaccggtaacgtccgttaccgacgggtacgtaccgttaccgtttctacgggttacggtaccctccggtagtaccgtaacggacggactaccggtacgtacgtaaccgtcggttactaagtctaggtaacgtacgtaacggccgtaaggaacgtaggacggtaacgngtacgtacgttataacgttacgaacgaaccgtaagtacggaacgtacgtaaacggttaacgtacgtacgttagttacggggttcggttaacgggacgggttaccgggaaccgttaacggtaccgtacgggtaaccggtccctttaagggacccgttaacgccccgggttaacgaccggttccccgaaccccgttcccgggtaaccc

SEQ ID NO: 201564 - DNA, 816 bp, Homo sapiens
  misc_feature: GYAE6OF01CCWG5.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctccccctcctcactctctgcacaggctctgaggcctcctatgagctgacacagcccacccgtcggtgtcagtcgtccccaggacacgacggccaggatcacctgctctgcagatcgactggaccaaaagtaaatatcggtatttacgttacggtaacccaaacgaagaacgaccgaacggccgaacggccccccgttaggttcggtttaagtcggtaatttaagttaaagttaaaacgtaaccgaaccgttagaacggaaccgggaccccttacgaaccggtagtaacgtacccgtacggtaggtaccggtactttccgttcggtcggtcccgtacctacggtaccgtacggtaaccggggaacgacggtacctacggttaccgtaccggtttacggaaccttacgtacgttaacgggtaacgtaacggtaaccgacggtacggaaggaaccggacgggacgtacgtacgtaacggttactttaaccgttagtaacgtaaacgtaacgttaacggaccgttaaaggtagggtaacggttaacgttacggttacggtttagggttaccgggttaggggtacccggggaacgggttaaccgacggttacccgtacgggtaacccggttaccccggtaaggtacccgtaaccggtaacccggtaaacccggcccggttaaccccgggtccccccggtttaacccggg

SEQ ID NO: 201565 - DNA, 685 bp, Homo sapiens
  misc_feature: GYAE6OF01CISE1.21.46.E02.1.454.CMB.1.raw
  modified_base (233)..(233): a, c, t, g, unknown or other
  misc_feature (233)..(233): n is a, c, g, or t
  modified_base (450)..(450): a, c, t, g, unknown or other
  misc_feature (450)..(450): n is a, c, g, or t
  modified_base (499)..(499): a, c, t, g, unknown or other
  misc_feature (499)..(499): n is a, c, g, or t
  modified_base (577)..(577): a, c, t, g, unknown or other
  misc_feature (577)..(577): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctctatgagctgacacagcccacccgtggtgtcacgtcgtaccccaggacacggaccggccaggactccaccgtgcctctgcagntcggactgaaccaaagaattgtcgtctttagtacggtaacctaaacgagaaacgcccgtaacggccgaaccggtccccttaggttacgtttaacggtagtaattaacgtaaataaaacgtaccacggttagaacggccgtcccctagaagacgtacgtcccgtaggacgtacgttactttccgtacgttcggacctccgacggtcctacggacggancgacgtacgtacgtacggtttcaattagactaggagtacggtacgaggngaaggcggaaggtcgtagtccgttattaacgtcgtaacgtaacaagtaggtactaacgtaggttaacgagtttaacgngttacggttcgggttcggtacgggtacggtaccgggacgtacggtacgcccggtacgtccggtaacgccgaacccggtcggaaccggtcctcccggtaccccgttcgg

SEQ ID NO: 201566 - DNA, 913 bp, Homo sapiens
  misc_feature: GYAE6OF01E20HG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtcccaggacaggacggccaggactcacctgctctgcagagtggactagaccaaaagaatatgtactttagttacggtaaaccaaacgaacggaaacgcccgaacgggcccgaaccgggtccccccgttggttacggtttaagtacggtaagtaattaaacgtaaaaacgggtaccaacgttcgggaaacggtacccgggtacccccgttagaaacggaacgggtaaacccttcccccgtagggaacgggtacccttaacgttttacccgttccggttaccggggtaccccttacccgaaccgggttacccttaaccggggaaaccgggggacaaaccgggtcccgtaaacggtttacccgtaaccggtttacgggttaaccctagtttaaccgaacgggttaacggttaaaccggaccccgggtaaggggtacccggaaacggggtaaacgggggtaaccgggtaaggggttcccgttaaacgggtaaccttttaacgttttaacccgttaagggttaaaccctaaaaaccggtaagggttaaacgaaacgggttaaggttaaacggggtaaccggtttaaccgttacgttaaggggtttcgggtttacgggttccgggggaacgggaaccgggtaaccgaacgggtccgttaccgggacccggtttaccgacggggttcccgaaccggtaccccggtaacggcccgtcccggccccccggttacgg

SEQ ID NO: 201567 - DNA, 788 bp, Homo sapiens
  misc_feature: GYAE6OF01AJSTV.21.46.E02.1.454.CMB.1.raw
  modified_base (135)..(135): a, c, t, g, unknown or other
  misc_feature (135)..(135): n is a, c, g, or t
  modified_base (570)..(570): a, c, t, g, unknown or other
  misc_feature (570)..(570): n is a, c, g, or t
tcagtcgtcgctcgcacgaccggtgctcgatttagactcatctacagggaaagggggtgggtccaggaggcagaactctgggtgtctcaccatggcctggactcctctacttcctcccctcctcactctctgcanaggctctgacgcctctatgacgctgacacacgccctacccgtggtcgtcagttccgtaccccgaaggaccacggaccggaccgaaggtacctccaccgttgtaccttccgacgacgtagtagtacggtaacctacgaaaaccgtaaaagtaacttcgtacgtttacgttagttaaccggaaccaaacgtaacgacgaccgaccggtaccaccggttccgttaggttacggtacgtataacttaagtaaagaaacgtcgtacgtaggacggaaccgtccgtagacggtagtccacgtggaccgttacgtctttacgcggtacgtccgacctacgtacgtacggaagacccgtaggttaccgacgtaacggtacttacgtactacggtacgtacgtaacggtaccggtaccggaaggaaccggttacgggaaacggngggtacgttacgtacgttaacctgttaaaccgacgtaaaccgaaaggtaaccgtaaggtaccgtaaaggttaccggtaacttagggtacggttacggtaggggttaaccgcgggttaaccggaagttacccgtagggtccccttaacgggccgttaacggtacgacccccggaagttaccccgggtaccgtacccgggttccctaacccgggttcccg

SEQ ID NO: 201568 - DNA, 805 bp, Homo sapiens
  misc_feature: GYAE6OF01EBFGW.21.46.E02.1.454.CMB.1.raw
  modified_base (548)..(548): a, c, t, g, unknown or other
  misc_feature (548)..(548): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggccttcctatgagctagacacacgcccacccgttcggtgtcagtccgtcccgaggacaggaccggccgaggactccaccgtgcctcgtcgacgagtacgtcgggacctacgaaaccgtaaaaagtaaatacgtacgtttaccgttttaaggtttaccggaacccaaacgaacggaacgacccggaaccggaccgtaccgggtcccccgttaggtttaggttaggtacgtaattaagttaaacgtaaacggtacctacggttaggaacggtacccgggacccttagaacggtacgtacccgttaccgtaggtaccggtacgttacgtttcctacggtccgaccctccggaacgtccgtacggaacggggtacacggacgtacgtcgtacgttacgaacgttanacgtagtacggtacgtaccgaggacgaaggacggacgaggtactacgtacttacgtttacgtacgtaacgaacggtaagtaacggaacgtagttaacggtacgttacgttaggttacgggtttaggggtacggttaccggggacgggtaacggtaacccgtaagggtacccggtacccgggttaacccggttaccggtaacggacccggtacccggtacccggacccggttccggccccggttcccgtaaccccggg

SEQ ID NO: 201569 - DNA, 699 bp, Homo sapiens
  misc_feature: GYAE6OF01BH8NK.21.46.E02.1.454.CMB.1.raw
  modified_base (252)..(252): a, c, t, g, unknown or other
  misc_feature (252)..(252): n is a, c, g, or t
tcagtcgtcgctcgcacgaccggtgctcgatttagactcatctacagggaaagggagtgggtccaggaggcagaactctgggtgtctcaccatggcctggatccctctacttctccccctcctcactctctgcacaggctctgacggcctcctatgagctgacacacgcccacccgtggtgtcagtcgtccccaggacagacggccaggactccacctgcctgtgacagatcggactgaaccaaaagtaatntgtacttaagtacggtaacaacgaagaacgaccgacgccacggtcccttagtcgttagtagtaactataacgtaaacgacacgtaggacgacggtccctacgaagacgtaactcccgagacgacgtattccgtcgttggacctcgaactcgacggtaagggaccagacgtacgtacgtacgttacaacgttaccagtaagtacgaacgttaccgagggtacgaaggacgggtaacggtacggtacgtacgtaaactttacgttaacctagtaaaccaaccgtaagtaccgaacggtagttaaaggacggtttactacggttagggttacgggttacgggttacccggggaacgggtaacgggaaccgtaaacggttcggtaaccgtaacccggttacgtaacggtaccgtaccggacccgtaacgggtcccgtcccggtacccccgg

SEQ ID NO: 201570 - DNA, 793 bp, Homo sapiens
  misc_feature: GYAE6OF01BK6VP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacagcccacccttcggtctcagtcgtccccgggaacaaaccggccaggactcaccgtgctcgtggacgatcgctagttacgaaaccttaaaaaagtttgtttacggttttttacggaaccaggtaccgtaaggtaaacggtaccgaacgggtacccgtaaccgggtcccccgttggtttacggtttacgggtacctaacgttacccgtaagttacgggaacgggtaaaccggacggggtaaaccggtaaccccggtaccccggtacccggggtacctacccgtaggaacgtacgttacttccgtcgtcgtacctaccgaacgtcggacggggtacggtcgacctcggttacgtacgttccgtacggtacgggtccgggaccgtagggtgggacgacgtaggacgtcgtacgtacttacgtacgttacgttacctacggacgcgtaacgtacgacggtcgtaacggttcgtacgacggtacgggacggggtctacggggttccgggacgggtacgggtacgtacgggttaccgaccggtacggtacgcggtaccgaccggtacggtcccgtcccgaccccgttacgggtacccttacgtcccgttcccgtccccgttcccgtcccgttcccg

SEQ ID NO: 201571 - DNA, 670 bp, Homo sapiens
  misc_feature: GYAE6OF01BC9Q7.21.46.E02.1.454.CMB.1.raw
  modified_base (137)..(137): a, c, t, g, unknown or other
  misc_feature (137)..(137): n is a, c, g, or t
  modified_base (182)..(182): a, c, t, g, unknown or other
  misc_feature (182)..(182): n is a, c, g, or t
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtgggtccaggaggcagaactctgggtgtctcaccatggcctggactccctctacttcctccccctctcactctctgcacnggctctgacggcctctatgagctagacatacgcccacccgtggtntcagtcgtacccgaggacacggaccggcaggactcaccgtgctctgcagatcggactagaaccaaagtaatcgtagtaccgtttaagttacggaaccaaacgaggaaccgccgaacggacccgacggtcccgttagttacggttagtagtataactaagtaacgacgtacgtaggaacgcgaccgtacgaagacgtaccgtccgtaggaacgtcgttacgttcgtcgtcggacctacgtacgcgacggacggtacncgtacgtacgtacgtgtacgtaatcgacgtagttacggacgtacgaggtacgaggacggacggtagcgtacgtacgtaacttcgtacaacttaagggctaacggtagtaacgtacggtatacgttcgtaagggttcggtacggtacgggacggtacggaacggtcgtacgttaaccggcgtcggttaccgtaccggacggtaaccctcgggtccgcccgttcccggttaccg

SEQ ID NO: 201572 - DNA, 753 bp, Homo sapiens
  misc_feature: GYAE6OF01APGA1.21.46.E02.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagccaccctggtgtcagtgtccccaggacagacggccaggactcacctgctctncagatggactgacaaagaatatgacttattggtacaacgagaacgcaggccacggcccctgtggttagagaatagtaaataaagacgtacctaggaacggtacggtcccctagagaacggtactccccgtaggacgcgttaactttccgtcgttcgggtcctaccgacgtacgttaacggacggggaacctacggacctaccggtccttaacggttacgttaaccgtaacgttacgaaggttacgtaacgggtccccgaagggtacgtaaggaacggaacgggacggtacgtaacggtaactttaacgtttaacgttacgtaaccgtaaacgtaagtaaacgtaaccggtaagggtaacggtaaaccggtttacgtaacggttaggtttacggggttaacgggttacggggtacccgggaacggggtaaccggtaacggcccggttacccgggtaacccgttaccgggttaacggtaccgtaacggtaccccgaaacgggttcccgttaaccccggttcccccggttaccccggg

SEQ ID NO: 201573 - DNA, 696 bp, Homo sapiens
  misc_feature: GYAE6OF01A699O.21.46.E02.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctggacggcctcctatgagctgacacacgccacccgtcggtgtcagtcgtccccaggacacggacggccaggactccacctgctcngcagagtcggactcgaaccaaagaaattgtcgtacctttagttacggtaaccctaacgaagaacggcccacggcccgaccggtacccccgttggttaggttacgtagaattaataaagtaaacgacaacgtgaacggtaccggtacctcgaagacgtcctacccgtgtacgccgtaattcctcgtcggtcctaccgcgtaccgtcggaacgggacgaccgtacgtacggttacccgtacggtttacgaaccttagtaccgtaacggttacggaacgttaccggaggtacgacgggaaccgggtaggaaccgggtctacgtaacgtttactacgttagaaacctaagacgtaagaacgtagtaagtacgtactgttaggttcgggtggtcggacgggaacggacgacggtactaccggtacccgttaggccgtacgaccgcccggaacgccttcccggccccttaccggg

SEQ ID NO: 201574 - DNA, 739 bp, Homo sapiens
  misc_feature: GYAE6OF01APMXU.21.46.E02.1.454.CMB.1.raw
  modified_base (135)..(135): a, c, t, g, unknown or other
  misc_feature (135)..(135): n is a, c, g, or t
  modified_base (177)..(177): a, c, t, g, unknown or other
  misc_feature (177)..(177): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacnggctctgaggcctctatgagctgacacacgccaccctcggtntcacgtcgtcccaggacacggacggccaggactccacctgcctcgtcggacagactcggactcgaccaaaaaggaaacttgtcggtactttaacgttcgggtaaaccaaaccgaaggaacgaccgaacgggacccacggcccccttaggtcgtttaaggtacgaattaagtaaataaacgacaacgttgaacggtacggtacccgtacgacggaacggtacctcccgttaggacgtaccggtaactttccgttacggcgtccctacgacgtaccgtacggaacgggtacacggtactaaggtcctacggttagtaccgtatacgtacgtacggtaacgtccggaagtacgaagggtaacgggaacggacggtacgtaacggacttacgttaccgtacgaaacgtaacgtaacgtaacggaacgtaagtacggtaaacggttaccacggtaggtttcgggcggttacggggacgggtacgaacggtacggtaccgacggtcccgtaccggttaacggtacccgaccgggtacccgtaacggtcctcccggacccccgttcggg

SEQ ID NO: 201575 - DNA, 717 bp, Homo sapiens
  misc_feature: GYAE6OF01DW16U.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttcctccccctcctcactctctgcacaggctctgaggcctctatgagctgacacacgcccaccctcggtgtcacgtcgtccccaaggaccaggaccggccgaggactccacctgctcgtgcagagtcggactcgaaccaaaagtaatactcgtactttacgttacggtaaccaaacgaacgaacgaccgaacggacccgacggtacccccgttggttacggtttaaggtacgtaattaagttaaacgtaaaacggactacggtaggaacggaccggtaccccgtagtaacgtacgtaaccgttccgtaggacggtaccgttactttccgttcgtccggtaccgttacccgacgtaccgttaacggaacgggtacgaacgtaccgtacgttaccgtaacggtttaccaacgttacgtaccgtaggttacggaaccgttacggacggacgaaggacggacgtagacttagtacttatacgtagtaacaacgagtacgacgtaaggtacgtaacgtctagttcggttggtcggtcgggacggtaagaccgacgtcgttacggtccgtcgttacgtacgaccgtacccgagtcccgtccgtcccgttaccgg

SEQ ID NO: 201576 - DNA, 597 bp, Homo sapiens
  misc_feature: GYAE6OF01CE5LZ.21.46.E02.1.454.CMB.1.raw
  modified_base (246)..(246): a, c, t, g, unknown or other
  misc_feature (246)..(246): n is a, c, g, or t
  modified_base (292)..(292): a, c, t, g, unknown or other
  misc_feature (292)..(292): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctggtgtcagtcgtccccaggacaggaccggccaggatcacctgcctcgtgcagatggactgaccaaagaatntgacttatggtaccaacagaacgccaggccaggcccctgtgttagngatataataagacactgagcggccctacagtanactccctgagtcgtacttctacgtcggacctccgacgtcctcgacgggtacagctaggtccacgttcgactagtacgagtagaaccgtccgaaggtacaggacggacgaggtctacgacttattacgtagtaacaaacgtagtaaggacagtagacggttactacgtagtttgggtgttacgggacggtacgggaaccaacggtctacggcccgttaccgtaacggttccgaaccggtacccgaacggtccgtacccggtcccccgttacgg

SEQ ID NO: 201577 - DNA, 847 bp, Homo sapiens
  misc_feature: GYAE6OF01EPHAV.21.46.E02.1.454.CMB.1.raw
tcagtcgtcgctcgcacgaccggtgctcgatttagactcatctacagggaaagggggtgggtcaggaggcagaactctgggtgtctcaccatggcctggatccctctacttcctccccctcctcactctctgcacaggctctgacggcctcctatgagctagacacacgccctacccgttcggtcgtctacgtccgtaccccgaggacacggaccggaccgaaggtactcctaccgtcgtccttcgtccgagtaacgtacgtacgaccgtacgaaaccgtaaaaggtaaattacgttagttacgttttaacggttaaccgtaaaccgaaacgaacggaaccgaccggaccggtaccgtaccgggtcccgtttaggttaggtttaacgtaagtaattaaagttaaaactaaacggtacacggttacggacggtaccgtccctaaggagtacgtacccgtccgagtaaccgtgttactttcgaccggtgtacccgtacgacgtcggtacggaacggactacgtacgtacgttacgtacggttaactataccggtaacgtagggttacgtaacccgtggaaacggacgtacgggaacgggtacgttacgtccgttaaacgttacgttaactttacgaaaccgtaagtaaacggactaacgggtaacgtaggttaacgtaacggtttacgttaggtttacggggtttcgggacccggggtagggaaaccggtaacccgggtaaccggtcgggttaacccgtaaccgggttccgtaacccgggtaaggttcccccgaacgggttaaacccccgttcgggtaccccccgttcccggtacccgtttaaccccgg

SEQ ID NO: 201578 - DNA, 560 bp, Homo sapiens
  misc_feature: GYAE6OF01CG6M6.21.46.E02.1.454.CMB.1.raw
  modified_base (243)..(243): a, c, t, g, unknown or other
  misc_feature (243)..(243): n is a, c, g, or t
  modified_base (342)..(342): a, c, t, g, unknown or other
  misc_feature (342)..(342): n is a, c, g, or t
  modified_base (421)..(421): a, c, t, g, unknown or other
  misc_feature (421)..(421): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccagggacagacggccaggatcgacctgctctgcagatggactgaccaaagaaatnttgcttaattggtaaccaaacagaagccacggccacggccccctgtcgttagtgatataataaagacactggagagggtcccctcgagacgattcccgngagcgtattctcgtggcctccagtctcgagggacagcagtcacgttagactatcagtgaacgtcaaggtgagaggacgngtactgactagttanacgtanaacagtaanacgtagtagagtacgtatgttaggtggttacggcggaagggtacgaaggcgtacggtacccggtccgtagggtcccaacggacccaagggccttccggcccccttcggg

SEQ ID NO: 201579 - DNA, 690 bp, Homo sapiens
  misc_feature: GYAE6OF01CMI7A.21.46.E02.1.454.CMB.1.raw
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctccactctctgcacaggctctgaggccctcctatgagctgacacagccacccgtcggtgtcagtcgtcccccaggacaggacggccaggatccacctgctctgcagatggactgaccaaaagaatntgctttattacggtaaccaacaagaacgacgacggaccaggcccctggttgttagngtatataataaagacactagagacggccctanagagactcctaggacgtcgtattctcgnggtcctaccgacgtctacgagggacagcgagttccgaacgtttcgaacgttacgtaccgaaggttacgaaaccggtacccgaagggctaaagggaccgggaacgacggttcgtaaggtaacttaactttaaccgtaggttaaaccaaaacgtaggtaacgaacgtaagtacggttaacggttacttacgtaaggttttcggggtacggttccggggaacgggtaacgggaacccgaacggtccgttaccgggtaacccgttacccggtagggtacccgaacggtaacccccgagggtacccccgttcccggtcccccggttaccgg

SEQ ID NO: 201580 - DNA, 890 bp, Homo sapiens
  misc_feature: GYAE6OF01C4Y3A.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggaccaggacggccaggactccacctgctctgcagatggactgaccaaaagaatatgtactttaagttacggtaaccaacgacgaacgccgaacggacccacgggacccccttaggttcggttaggtagtaacttaataaagtaaaacgactacgtaggaacggacgtccccttagaacggagtaccgtaccccgtagacggtccgtactttccgtccgtcgggacccttacccgaacgtccgtaaccggaacggggacccgtacggtacgtaacggtttaccgtaccggttttagaaccgtttaaacgtaccgtaaaggggttaacggtaaacccggttacccggaaaccgggacggaaaacgggggtaaccggggaaaccggggaacgggttacccgtttaacggttaaacccgtttaacgttttaaccgtaacgggtaaaccttaaaaccggaagtttaaacggaaaccggttaaagggttaacggttaacggtttaacccgtacgggtttaagggttttccgggggttacggggtttacccgggtacggggggaaaccggttaacccggaaacgggtcccggtttaaccgggaaccccccgggttttaccgggttaaccggttaccggaaacccgggtaaacccccgggtacgggtacccggttacccccccgggcccccccgtttaacccgggg

SEQ ID NO: 201581 - DNA, 732 bp, Homo sapiens
  misc_feature: GYAE6OF01CO29M.21.46.E02.1.454.CMB.1.raw
  modified_base (710)..(710): a, c, t, g, unknown or other
  misc_feature (710)..(710): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctagcgcctcctatgagctgacacacgcccacccgtggtgtcagtcgtccccgaggaccaggaccgaccgaggactccacctgcctctgacgagtacgtggactacgaacctaaaagaattgtatacttacgttacgtaaccaagtaagacgaccgacggaccgccggtccccgttagttacggtacgtagtaagtagttaaacgtaagaccgtagtaggaccggtacgtaccccgtagaacggtaaccgaccttccgaacggtgtaccgtttaccttccgtccgtcgtaccgtaccgacggtcctacggaacggtacgaaccgtacgtcggtttaccctaaggttccgtaacgtagtaaccgttaggacgttaccggtacggaacggacggaaggtaccggtaggaaccggttctaacgttacgttacttaacgtaacgtactaaacgtggaacgtaacggtacgtaacggttaagtacccgtttagtcgggtttaagggtcgggttaccggggaccggtaccggacgtaggccggtaacgtcccggtacgtacggcgtaccggaccgtntaccccgtccgtcccgtaccgg

SEQ ID NO: 201582 - DNA, 819 bp, Homo sapiens
  misc_feature: GYAE6OF01C0UYP.21.46.E02.1.454.CMB.1.raw
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
tcagtcgtcgctcgcacgaccggtgctcgatttagactcatctacagggaaagggggtgggtccaggaggcagaactctgggtgtctcaccatggcccggatcccctctacttcctccccctcctcactctctgcacaggctctgaggcctcctatgagctgacacacgcccaccctggtgtcagtcgtccccgaggacaggacggccaaggatccacctgctcngcagntggacngaaccaaaagtatagtgtacttagttacgtaaccaaacaggaacgaccgacggccgacggtccctggttacggtaagtgtaagtaataaacgtaaacgtacaccgtaggacgtacggaccctacgaagacgtactcctaggacgcgtacttccgtcgtcggtccctacgtacgtcgtacggacggtacgacgtaccgacgttaccgtaggttctaacgtacgtacgtacggtagtaaccgtacgacggtacgagggaaacggacggacgggtacgttaacgttaacttacgtttaaccgtaacgttaaacaaaaccggttacggtaaacggtaacggtaaacgggtttaacggtaacggtttaaccggttaacgtttaacggggttttaccggggtttaccggggtaaccgggggtaccggggtaaacccggggtaccggtaaaaccgggttccgggtaacccgggttaaccccgggtttacggttaaacccgggggttaaccgtaacccccgggtaaaccggtaaacccgggttccccgggtaacccccgttcccccccggggttaacggtttacccccggg

SEQ ID NO: 201583 - DNA, 717 bp, Homo sapiens
  misc_feature: GYAE6OF01BF4RR.21.46.E02.1.454.CMB.1.raw
  modified_base (254)..(254): a, c, t, g, unknown or other
  misc_feature (254)..(254): n is a, c, g, or t
  modified_base (593)..(593): a, c, t, g, unknown or other
  misc_feature (593)..(593): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggccctcctatgagctggcacagcccaccctcggtgtcagtcgtcccgaggacacgacggccaggactccacctgctctgcagagtcggactcgaccgaaaagtaaatnttacggtactttagttacggtaaccaaacgaagaacgaccacggaccgacggtccccttggttacgttaggtagtaattaagtaactaaaacgtacgacgtagggaacgtaccggtcccctacgaaggtacgtacctccgtaggacggtacttacgttccgtacgtcggtacccttacgacggtcgtacggaagggaccaggtaaccgtacgtaccgtaacgtttacgtaacctagttacgtaggtacgaacgtacgtagacgaagggacggacggtaggtacttagtaccttattacgtacgaacctaagaccgtaagaccgtaagtaagtccgtaancggttagggttcgggtcgggtcgggaacgggaacgtaccggtacggttacggcggttaccccggttacgtaaccgaccgggaaccgtaccggtaaccggcccgtccccggtcccccggtaccgg

SEQ ID NO: 201584 - DNA, 815 bp, Homo sapiens
  misc_feature: GYAE6OF01BLQSW.21.46.E02.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagactcatctacaggggaaagggggtgggtccaggaggcagaactctgggtgtctcaccatggcctggatccctctacttctcccctcctcactctctgcacaggctctggaggcctcctatgagctgacacagcccacctcggtgtcagtcgtcccaggacaggaccggccagggactccaccgtgcttcgngacgagtacgtcggactacggaaaccaaaagaaacttgtcgtacgttttaacttacggtaaccaaactacggaacgccgaaggccgtaacggtccccgttggttaggttacgtagaagtttaagtaaagtaaaacggaacctacggtaggaaacggtaccggtacccgtacgtaacgggtacgtaaccgttcccccgaagggttaacggtaccgttaacgtttcccggtaccgtttccgggtacccgttaccgaaacggtcccgtaaaccggggaagggtaaccgtacggaccgtacggttaacccgtaacgtttacgtaacgttaacgtcggtaaacgtacggaaaccgggttacccggaaacggcggaaacgggtaacgggtacgaggtactacggtaacttaacgttactacgaaaccgaaagtacgtaaaggtaacgtaagggtaacgtaacggttacttaggtagggtttggggttaccggtcggggacggtaaccggggactaacgggtccggtaacggtcccgggttagttaccgggaccgtaccggaccgtaaccggtcccggtcccgtacccccggtccg

SEQ ID NO: 201585 - DNA, 670 bp, Homo sapiens
  misc_feature: GYAE6OF01CYNRW.21.46.E02.1.454.CMB.1.raw
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggaccagacggccaggatcacctgctctgcagatggactgaccaaagatntgntattgtacaacanagcacgacncgccncgtgtatgatatataanacatagagaggcctactagagactaccgtgagctacttcttctggcctcacgacgtcaacgggacgacgacgtacgtcgtaacgttggtaacctagtaccgtagtacggacgtacgacgtaggaaggagggaccgaggtctacggacttacttacgtacgttaacgaaacgtaagaacggtaacgtaaggttaggtaacgggttacgtttaccgtagggtttaacggggttcggggttaccgggtaccggggtaagggtaaacccgtaaacggttacccggttcgggttaaaccccgggttcccggtttaaacggggaccccgtaaccgggaaacccccgtagggttaccccggtcccggttccccccccgttaacccgggg

SEQ ID NO: 201586 - DNA, 641 bp, Homo sapiens
  misc_feature: GYAE6OF01CO4T8.21.46.E02.1.454.CMB.1.raw
  modified_base (164)..(164): a, c, t, g, unknown or other
  misc_feature (164)..(164): n is a, c, g, or t
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacgaggctctgacggcctcctatgagctgacanacgccaccctggtgtcagtcgcccaggacagacggccaggatcacctgctcnggcagatcggactgaacaaaagaatntcgacttattacggaaccaacgagaaacgcgaacggaccgacggacccctggtagttaggtanataataataagacctagagacgacggtcccanacganactaccgtagacacgtattcctcgtggaccncgacgtctcgaaggggacacgcgagtaccgaaggtttcaacttctacgtaaggtagtaacggaccgaaggacggaaagtacgggaacgacgggtcaaggtaacttaagttaccgtaagtaacaaactaggtaacgaccaagggtacgtagttactacgtaggttgggttacgtacggacggggtaggaacccgtaagtctaacgggtcccttaaccggtagtaaccgacccggaacgttaccgggccttaccgccccgggtttaaccg

SEQ ID NO: 201587 - DNA, 706 bp, Homo sapiens
  misc_feature: GYAE6OF01BJF8N.21.46.E02.1.454.CMB.1.raw
  modified_base (183)..(183): a, c, t, g, unknown or other
  misc_feature (183)..(183): n is a, c, g, or t
  modified_base (251)..(251): a, c, t, g, unknown or other
  misc_feature (251)..(251): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggccttcctatgagctgacacacgcccacccgtcggtntcagtcgtccccaggacgagaccggcaggactccactgctctgcagatggactgaaccaaaagtaatntacgttactttagttacggtaaccaacgaacgaacgaccgacggacccgaccggtccccgttaggtttacggttaggtagtaattaagtaaacgtaaacgaacacgtacggaacggaccggtaccctacgaagtacgaccttcccgtaggaccgtacgtactttccgtcggtcggcctaccgtacgtccgtaacggaacggacacgtactaacgtttcgtacgttacacttagtacgtaggtacgtaacgtcgacgacgaagggtaccggacgacggtactacgtacttacttacgtacgtaaacaacgtagtaacgaacgtagggtaacgttaggtacttagtagggtttcgggagggttcccgggacgggtaacgtacgtacgtaccgtacgggtcccttacggtaccgtacgacccggacggtaacccgcccggtcccgtccccggttaccg

SEQ ID NO: 201588 - DNA, 689 bp, Homo sapiens
  misc_feature: GYAE6OF01A4AZU.21.46.E02.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgacgctgacacagcccacccgtggtgtcagtcgtccccaggaccaggaccggccaggactccacctgcctctggcagtntggactcgaaccaaaagaattgtnattagttacggtaaccaacgagaacgccgtacgccgacggccccttggtcgttagtgaataactaataaacgactaacgtggtaacgacggtaccctacgaagacggtactacccgtagacgcgtacttctcgtcgtcctaccgcgcacgtacggacacgacgacgtacctacgttacacttacgtagtagtaacgacgtacgacggacgagggaacgggacgacggtactagtacttacgtaacgtagtaacaacgtacgacgtaacgaacggtagtacggtacttcggtagggtttacgggttacggtacgggtacgggtaccgggaaacgacgggttaccgttaccggtacccggttaacccgttacgggttaccccggaaaccggccggaaacccggtccccgggtccccgtcccccggtaacccgg

SEQ ID NO: 201589 - DNA, 735 bp, Homo sapiens
  misc_feature: GYAE6OF01BLB63.21.46.E02.1.454.CMB.1.raw
  modified_base (179)..(179): a, c, t, g, unknown or other
  misc_feature (179)..(179): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (465)..(465): a, c, t, g, unknown or other
  misc_feature (465)..(465): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgcccaccctcggtntcagtcgtcccaggacagacggccaggactcacctgctntgnacgagtggactcgaccaaagtaaatagcgtacgttattacggtaccaacgagaacgccgacggccaccggtcccctaggttagttagtacgaagttaataacgtaaaacgcgacgttggaacggtaccggtcccgtacaagggtacgaacccgttaccgacggacgtaccggtattccgtcgtacggtccctaccgacgtccgtagacggacgtacgcgtacgtaccgtacgttactacgttanacgtaggtacgtaacggtaacccgaaggtcggaaggaccgggagggtacggtactgtaaacttagtccgtaagtaccaaacgtacggtaactaacggtagtaaccggtacgttacgtaagttacgggttggggtacgggttaccggggttaaccgggtaacggggtaaccgtacggtaccggttaacccggtcccgttaaccgggttaggtaacccggtaacccgggaccgtaaccggggtacccgtccccggttccccggttaacccgg

SEQ ID NO: 201590 - DNA, 829 bp, Homo sapiens
  misc_feature: GYAE6OF01DF23D.21.46.E02.1.454.CMB.1.raw
  modified_base (251)..(251): a, c, t, g, unknown or other
  misc_feature (251)..(251): n is a, c, g, or t
tcagtcgtcgctcgcacgaccggtgctcgatttagactcatctacagggaaagggggtgggtccaggaggcagaactctgggtgtctcaccatggcctggactcctctacttcctcccctctcactcgtctgcacgaggctcgtgacggtccttctatgacgtctagacacacgccctaccgtcggtcgtcgacgtccgtacccgaaggaccacggtaccggacgaggtactacctaccgtgtccgttcgngacgagtagttacggactaacgaaccgtaaaaggacttgtacgttacgttacgtaacgaacaacgagaaccgccggtacgaccgtccggtaccgtggttagtacgagtaacttaataaacgtaaacgtactacggtacggaacggtaccgtaccgtaacgaacgtacgttcctaccgtaggtaccgttaacgtttacgttccgtaacggtccgtaccgtaaccggtagtaccgggtacggaaacgggtacacggtacgtaaccggtacgttacgtacgtaacgttaccgtaggtacggtaacgtacggacggaggtacggaacggaagggtaccgtacgtacgttaacgttaaacgtttacgttaacgtaaacgtaaccgtaaaacgggtacgaacgttaaaccggtaggggtaaacgtttccggttaaagtttcgggttaacggggtttgggttacccgggaacggaccggggtaaacacggttaccgtacccggttaacggttcccgaaaccggtttgggaacccgttaaccgggacccgttaaccggccccgttaacccggttcccggtttaccg

SEQ ID NO: 201591 - DNA, 687 bp, Homo sapiens
  misc_feature: GYAE6OF01EVDDV.21.46.E02.1.454.CMB.1.raw
  modified_base (182)..(182): a, c, t, g, unknown or other
  misc_feature (182)..(182): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcatctacagggaaagggggtgggtccaggaggcagaactctgggtgtctcaccatcggcctggatccctctacttcctcccctcctcactctctgcacgaggctctggacggccttctatgagctagacacacgccctaccctntgtctctagtccgtcccaaggacaggaccggaccaggactccacgtgctctagacagacgtacggactacgaacctaaagtaatgtacgttacttagtacgaaaccaggaacgacgccgacggccgaccggttccgtgttacgttaagataactaagtaacgaaacacgtacgtaaggaccgtccggtactaggaagactaccgtcgtagatccgttagttcctggtacnctaaaccgngtacccgtaggaacgcgtaagtccgtacgttaccctagttatacgttaacgtagacggttaacgaccggactagggagtaacggaacgtcgtaagtccgttacgtaatacgttaacgtcgaaactaggtacgaactggtaagttcgaagttcggtaacgtgggtttcggtacggacgggaaccggtaagccgttaagccggttaacgttcccgggtaatccggaaccgttccgggaacccttccgggtccctccgggttaaccccg

SEQ ID NO: 201592 - DNA, 739 bp, Homo sapiens
  misc_feature: GYAE6OF01ADPTK.21.46.E02.1.454.CMB.1.raw
  modified_base (180)..(180): a, c, t, g, unknown or other
  misc_feature (180)..(180): n is a, c, g, or t
  modified_base (266)..(266): a, c, t, g, unknown or other
  misc_feature (266)..(266): n is a, c, g, or t
  modified_base (712)..(712): a, c, t, g, unknown or other
  misc_feature (712)..(712): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctagacactcgccctaccgtcggtntcgagtcgtccccaggacaggaccggccaggactccaccgttgccttcgtgaccagagttcggactacgaaccaaaagaaacgttntacgtcttaagttaccggaaaccaaactacggaaccggtaccgacggacccgtaaccggtccccttaggttacggttaaggtagtaacttaaacggttaaataaacggaaccgtacggtaggtaaccggacggtaccccttagaaccggtaacggtacctaccccggaggtaccgtcggttaacctttccgtcgtacggtaccctaccgacgtcgtaaccgacggggtcaacgtacctaggtacgttacgtacgaacttagaacgttagacggtaccgtacggtaacgacgacggtaacggacgtcgggactcggtaactttaacggtactaagtaaccgaagttaacgacgtaaggtaacgtacggttaaccgtgttaaccgtgggttacgggtcgtaacggacgggtaaccgacgtacgcggttacgccgttacgacgtaaccncggacctaacggcctccgtaccctcgg

SEQ ID NO: 201593 - DNA, 821 bp, Homo sapiens
  misc_feature: GYAE6OF01CNJED.21.46.E02.1.454.CMB.1.raw
  modified_base (154)..(154): a, c, t, g, unknown or other
  misc_feature (154)..(154): n is a, c, g, or t
  modified_base (235)..(235): a, c, t, g, unknown or other
  misc_feature (235)..(235): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctctangagctgacacacgccctaccgtcggtgtcgagtccgtaccccgaaggacgacggaccggaccgaggactccacgtgctcgngcgagagtacggactacgaaccgaaaagtaatacgttagtactttaggttacggaaaccaacgaacggaacgaccggacggacccgaccggtccgttaggttagtagtacgtaataagtaaagtaacgacgtacgacggacggtaccgacctagaacggacgtaccgtaccgaggacgttaccgtacgtttccgccggtcgtacccgtacgaccggtaccggacggaacgggtacacggttacgtaacgttaccgtaacggttactaaccgttaacggtacgtaacgggtacggaaccgtaccggaagggacggaaagggacggtaagggcggttacgtaacgttaaccgttaagttaacgtaacgtaaacgaaacggtaacggtaacggtaacggtaaacgggtaaggttaacggttaccgttaaggttaccggggtagggttaccgggtaacccggggtaggggtaaacccggtaaccgacgggttaacccgggtaccggttaaccgttacccggggtaaccggtacccgtaacccgggtaacccgggacccgttcccgggttaccccgttacccccggttacg

SEQ ID NO: 201594 - DNA, 685 bp, Homo sapiens
  misc_feature: GYAE6OF01E4NIF.21.46.E02.1.454.CMB.1.raw
  modified_base (242)..(242): a, c, t, g, unknown or other
  misc_feature (242)..(242): n is a, c, g, or t
  modified_base (560)..(560): a, c, t, g, unknown or other
  misc_feature (560)..(560): n is a, c, g, or t
  modified_base (612)..(612): a, c, t, g, unknown or other
  misc_feature (612)..(612): n is a, c, g, or t
  modified_base (630)..(630): a, c, t, g, unknown or other
  misc_feature (630)..(630): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgccacccgtgtgtcagtcgtcccaggacacgacggccaggatcacctgctctgacagatcgactgacaaagtaattntagtcttagttaccggtaaccaacgaacggtaacgcccgaacgggaccaccgggtacccccgttggtttagtttacggttagtaacgtttaaacgttaagtaaaacggtaacctaccggttagggacggtaaaccgggtccccttacgaaaggtacgtaccgttacccgtaggacgtaccgtactttccgtacgtcggggtccctaccgacgtccgtaacggacggtaaccgacgtcgtacgtacgttaccgggtactaactcgtacggagtacgaacgtcccgagacgagaggtacagggtcaagtcttacttacgnaacgaagcgtaagcaaggtacgagttctaggtagttggggtacgtacggggngtaaccggtacgacggtntaccggtcccggtatacgggtccacgggtaccaaggtccctcccggtccccttcg

SEQ ID NO: 201595 - DNA, 735 bp, Homo sapiens
  misc_feature: GYAE6OF01EFNRY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctactcctccccctcctcactctctgcacaggctctggacggccttcctagtgagtctgacacacgcccacccgtggtgtcagtccgtcccgaggacacggccggaccaggactccacctgctctgacagagtcggactcgaacaaaagtatagtagtacttagtacgtaaccaagagaacgccgacgaccaccggtcccttaggtgttagtagattaataacgtaaagaccgtagtaggaaggtacccgtacctacgtaagaagtaccgtccgtagacgtacgtacgttcgtcgtacggccctacgcggtaccgttaccggaacgggacctcgtacgtacgttaacccgtagttaacgtacttaacgacgtacggtacgtaaccgtacggaagacggagggaccggaccggtacgtagtaacgttacttacgttaacgtacgtaaacgacgtaagtaacgtaacggtaagtaggttaacgtacttagggttaggttacgggtcggttaccgggggaacgggtaaccggtaccgagggtaaccccgttacggtacccggttaccggtaccgggtaaccctaccggggacccgtaacccgggaccgttccccgtacccggtttaccccgg

SEQ ID NO: 201596 - DNA, 816 bp, Homo sapiens
  misc_feature: GYAE6OF01E1ZN8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacacgcccacccgtcggtgtcagtcgtccccaggacagacggccaggatcacctgctctgcagatggactagaccaaaagaatagtcgtctttaatacggtaaccaacgaaggaaccgaccgacggtacccgaacggcccccttggtacggttacgtagtaataacgtaaactaaaacgacgtaacgtcggaacgaccggtaccccttgaaacgtacgtaacctccccgtagaacggtacgtaactttccgtacgtcggccctaaccgagttaccgtaccggaacggacgaccggtacgtacgttacggtaacgttagtaaccttaactacgtacgggtttaacgaacccggttaccgaacgggacgaacgggaaaccgggaccgagggttactaacgttaaccgttaacgtttaaacctacggttaaccaaaaacgtacgggttaaaccgtaaacggttaaaggggtaaaccgttaacggttaaccgtttacggttaagggttcgggtttaaccgggttacgggggaaccggaaaccgggtaaaaccggtccgttaaccggtaacccgggttacccgtaaccgggttaaccgaccggttaaacccggacccccggtaaagggtccccttaaccccggcccccgggtttaacccg

SEQ ID NO: 201597 - DNA, 786 bp, Homo sapiens
  misc_feature: GYAE6OF01DZJYA.21.46.E02.1.454.CMB.1.raw
  modified_base (141)..(141): a, c, t, g, unknown or other
  misc_feature (141)..(141): n is a, c, g, or t
  modified_base (507)..(507): a, c, t, g, unknown or other
  misc_feature (507)..(507): n is a, c, g, or t
  modified_base (747)..(747): a, c, t, g, unknown or other
  misc_feature (747)..(747): n is a, c, g, or t
tcagtcgtcgctcgcacgaccggtgctcgatttagactcatctacaggggaaagggggtgggtccaggaggcagaactctgggtgtctcaccatggcctggactcccctctacttcctccccctcctcactctctgcacgnggctctggacggccttcctatgatctagaccacgaccgccctacccgtcggttcgtacctaggtccgtaccccgaaggaccaaccggaccggccgaaggactccctacctggcctcgtcgacgtaaggtacgtacgggacctacgaaaccgtaaaaaggtaaacttcgttcgttaaccgttttagttaaccggtaaacccaaacgaaggaaccggaccgacggacccgtaacgtccccgttaggttaggttagacgttaaacaagttaaacgtaaaacggtacctacggtacgaaccggaccggtaacccgttagaaacggtaaccgtaccgttacccgtaggaacgtaccggtttctttacccgngttacgggacctaccgacgttccggaacggacggacgtacgccgtaagttacccgtaagtccgtaacgtacgttacggacggtaacgtacgcgtaacggaggtaacggaagggtcgaaggtacgtacgtaactttagttaccgtacgaacaagtacggtaacgtaacggtagtacggtactacgttaggttagggttacggttcgggaacggtccgggacggaacgacgtgtccggtacncccggtagccggtacgaccgaccgtccgtccgtccgacg

SEQ ID NO: 201598 - DNA, 684 bp, Homo sapiens
  misc_feature: GYAE6OF01CN7EP.21.46.E02.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctcgtgacggccttcctatgagctgacacagccaccccgtggtgtcagtcgtccccgaggacagacggccaggatcacctgctcngcagatcggactagaccaaaaagaatagtgtactttattacggtaccaaacaaggaacgaccgaacggaccctaccgggtaccccttggttagttaacgtagaactttaataaagtaaaacgaaccgtaagtacgaacggtacgaccctacgaacggaactaccgtacccctaggacgtacgttacgttcgtacgtcggttaccctaccgagttccgacggtaacggacgacgacgtactacgtacgttagacttacacgtagtacgacggtcgaggtacagggtacgaggcgtatcgtaacttataacgtgtaaacgtagtaagtacgtaagtaaggtagtacggttaaccttagtaggtttgggtacggttcgggaaccggtaggtacccgaggtcctacgggtaccgtacccggtagtaccgtaccggaccgaggtcccgtcccggtcccggttaccg

SEQ ID NO: 201599 - DNA, 889 bp, Homo sapiens
  misc_feature: GYAE6OF01CACUM.21.46.E02.1.454.CMB.1.raw
  modified_base (266)..(266): a, c, t, g, unknown or other
  misc_feature (266)..(266): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggtcctcctatgagctgacacgacgtcccacccgtggtgtcaggtccgtccccgaggacacggaccggccaggactccaccgtgcctctgcagtagtacggactacgaactaaaagaattntagtactttagttaccggaacctaaacgaggtaaccgcccggaacggccccgtaaccgggtccccgttaggtttacggttaggtacgttaagtttaaacgtaaacgttaaaccggtacccgtaaggtaggtaacccgggtaccggtccccttaaggaacgtacggtacccttcccgggtaaggtccgtaaccggtttacttcccgttaccggtcccggtaccctaccgggtacgtaccggtaacggaacgggtacccgacgttaaccggtaccgtttacccggttaacgttaccgtaacgttacgtaaccgttaagggtacggtaaccgggtacccggagggtacgaaccggggtaggtacgggtaccgtacggtattaaaccggtttacgttaaccgaaacggttaccaaaggttaccggttaaagaacggttaaggttaaccgggttagtaccgtttacgggttaggggtttccggggtagggttaccggggacggggtaacccggttacgtacccggtccggggttaaccccgttcccggggtaccggttcccgaaacccggtccccggtaaacccggacccgggtttccccggtaacccccggtcccccggttaacccg

SEQ ID NO: 201600 - DNA, 680 bp, Homo sapiens
  misc_feature: GYAE6OF01C9VIQ.21.46.E02.1.454.CMB.1.raw
  modified_base (107)..(107): a, c, t, g, unknown or other
  misc_feature (107)..(107): n is a, c, g, or t
  modified_base (176)..(176): a, c, t, g, unknown or other
  misc_feature (176)..(176): n is a, c, g, or t
  modified_base (241)..(241): a, c, t, g, unknown or other
  misc_feature (241)..(241): n is a, c, g, or t
  modified_base (542)..(542): a, c, t, g, unknown or other
  misc_feature (542)..(542): n is a, c, g, or t
tcagtcgtcgctcgcacgaccggtgctcgatttagactcatctacagggaaagggggtgggtccaggaggcagaactctgggtgtctcaccatggcctggatccctntacttctcccctcctcactctctgcacaggctctgacggcctctatgagctgacacagccaccctggtntcagtcgtcccaggacagacggccaggctcacctgctctgcagatggactcgacgtaaaagaatntcgtactttaagttacggtaaccaacgaagtaaccgaccgacggaccaacggccccttggtagttacggtgtaataataagtaaacgacacgtagaggtaacggtccctaagacgaacgtcgtacccgtggacgacgttacttccgtcgtacggtcccttccgaacgtccgtacggaacggggacctacggtacgtaacgtcgtacgttacgaacttacacgtaaggtacgaacgtccgaggacgaaggacggtacgaggtcctagactttagttaacgttagaacctaaagtaacggtanaacgttaaggtagttaacgtaccttagtcgggtttaggtacggttacgggacggtaacggtaacgacggtacgtacggtacccggttacgtaaggtacccgacgtaacccgtaggtccctcccggtcccgttaaccgg

SEQ ID NO: 201601 - DNA, 862 bp, Homo sapiens
  misc_feature: GYAE6OF01CQ8BZ.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggactccctctacttcctcccctctcactctctgcacaggctctgacggcctctagtgagctagacacgacgccctacccgtcggtcgtcgtacgttccgaccccgaaggacgacggaccggccgaacggtactccgactcgccttcgngacgagagtacgacgtacgaacaaaagtaactgtacgtacgtttacggttacgaacaagaacgacgcgacggccgacgtccgtgttacgtatagtaattaacgaagtaacacgtacgacggaacggaccgtaccgtagaacgtacgtaccgttaccgacggtacgttacgtacttttcggaccgttccggaccctacgtacgggtaccgtaacggaaccggggaactacggggtaaccgttaacggttaacccggtagggtttaaccgtaaccgttaacgtaccgggttaacgggttaacgtaacccgggaaccggttaaaccgggaacgggtaacggggaaacccgggttaacggggtaccgttttaacggaaaccgtttaacgtttaaccgtacgggtttaaacgtaaaccggttaaaggtaaccgttaacggtaacgttaacgggtaaacggtttaccggttaggtttaacgggttacggtttacgggggtacgggttaacgggaccggggtaaccgttaaacggcggttacggtaccggtaacggttaccggtaccggtaacgtacccggtaaccggttacccgtcccggtaccccgttaccggtacccgg

SEQ ID NO: 201602 - DNA, 879 bp, Homo sapiens
  misc_feature: GYAE6OF01ANXG9.21.46.E02.1.454.CMB.1.raw
  modified_base (138)..(138): a, c, t, g, unknown or other
  misc_feature (138)..(138): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctctgcacgnggctctggacggcctcctagtgagctcgacacacgcccctaccgtcggtctcgacgtccgtcccgaggacgaggaccggccgaaggtcctaccaccgttcgcctcgtacgacgaggtacgtcggacctacgaaaccgaaaagtaagtactcgttacgtttacgttaacggtaaccaaacgaagaccgaccggaccggaccgtaccggtaccccgtttggttaggttaacgtagtaattaaacgttaaagtaaaccggaccgtaacgtacggaacggtaacccgtcccgtaagtacgacgtacccgtaccggttaggacgtccggttaacttccggttacgtaccggtccgtaccacggtaccggttaccgggaacggtacctaccggtaacgtaccgggttaccttaagggtttaaccctaccgttaacgttaacggggtaacggttaaccggttaaccggaaccggtaaaccgggtaacgggaaacgggttaacgggaccggtaaccggtttacggtaaacggttacgttaacgtttacgttaaacccgtaaacgtaaacgggttaaccgtaaaggtaaccggttaagggttacgggtaaacgtttccggtacgggttaggggttccgggttaccggggaacgggtaccgggaacggtacccgttcgggacccgtacgggtaccgttaccggacgtaccggtacccggacgttacccggcccgtccccggtccgttcccg

SEQ ID NO: 201603 - DNA, 690 bp, Homo sapiens
  misc_feature: GYAE6OF01A8EGV.21.46.E02.1.454.CMB.1.raw
  modified_base (406)..(406): a, c, t, g, unknown or other
  misc_feature (406)..(406): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccaggacagaccggcaggatcacctgctctgcagtatggactagaccaaaagtaaatatgtacttagttacggtaaccaacgaggaacgccgaacggcccgaccgggtcccctggttaggttagttgtaattaagtaaagtaaaacgaccacgtaggacgaccggtccctacgagaacgtactcccgtagacgcgtattccgtcgtcgtcctacgngcgtacggaacgggtacacgacgtacgttccgtaggttacgaccgttacgtcgtaacgttacggaacggtacccgaagggacggaacggaacgggaacgaggtactagtaactttaagttacgtaagtaaccaacgtaaggtacgaacgtaggtaagtacggttactacgtagggttccgggtggttacgggacgggtaacgggaacgtacggtacgtaccggtcccgttacggtcggtacgacccgaaccccggagtccccggttcccgtacccccggttcgg

SEQ ID NO: 201604 - DNA, 725 bp, Homo sapiens
  misc_feature: GYAE6OF01AYZ36.21.46.E02.1.454.CMB.1.raw
  modified_base (156)..(156): a, c, t, g, unknown or other
  misc_feature (156)..(156): n is a, c, g, or t
  modified_base (178)..(178): a, c, t, g, unknown or other
  misc_feature (178)..(178): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgacggcctcctatganctagacacagcccaccgtggtntcagtcgtcccaggacagacggccaggactcacctgctctgcagtatggactgaaccaaaagtaaatgtcgtacttagttacggtaaccaacgacgaaacgccgaggccacggccccttgtacgtagtagaatataacgtaagactacgtagacgacgcctagacgatactcccgagaacgtcgttaactccgtcgtaggtccaccgtacggtactacgaacggggtacacggtacgtacgttaccgtagttaccggtaactaagtaccgtaagggtacgtaaacgtacccgaaggtacccggaaagggacggtaaccggaacggtacccgttaaagttaaccggttaaccttttaacgttacggtaaaaccgtaaaccggtacggtttaaacggacgtaaaccgggttaagggtaaccgtaaccgtttagtaacgggtttcgggtcggtacgggtaccggaaacggtaacccgtaaggtccgtacggtaacccggttacgttacgaaccgtaccgaccgaagtcccggtccgtcccggtaacccgg

SEQ ID NO: 201605 - DNA, 952 bp, Homo sapiens
  misc_feature: GYAE6OF01CT82N.21.46.E02.1.454.CMB.1.raw
  modified_base (169)..(169): a, c, t, g, unknown or other
  misc_feature (169)..(169): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctcctatgagctgacccccanacgcccctaccccgtcgggtgtacacggttcggtacccccgaaggaacgaccggaaccgggtcccgaagggtaaccttccctaacccgttggccctttcgtagaccgtaaaggtcgttagggaacccctaggaaaaccctaaaaaggtaaaattcgttacggttaacgttttaagtttaacccgggtaaaacccgaaaacgaaaggtaaaacccggaaccccggtaaccgggaccctacccggggtcccccgttaagggtttacggtttaaggtaagtaagtttaaaacttaaaacgtaaaacggtaacccgttaaggaacgggtaaaccgggaccgggtacccctttaaccgggaaaaggtaaccgttacccgtaaccccggttaggaaggttcccgttaaccgttttcgtaccggttacggggtcccttaaccgaaccggtcggtaacccgggaaagggaaaccccgtgggtaaacgtaccgttttacccggaaacggtttacgtaacctttaacgtacggtaacggtacggtaaacccggcggaacggtacggaacgggtaacgggacggtaacggtacgttacgtaaaccgtttaagtttacgtaacgtaaacgtaagtaaacgtaagtaaccgtaaggtacgtacggtaacttaccgggttaggttcggggtacggttacggggacggtagggtaaccgtaacggcggttaaccgaccggttaccggtaccgtacgacccggtaacgtacccggtccgtcccgtccccggttacccgg

SEQ ID NO: 201606 - DNA, 680 bp, Homo sapiens
  misc_feature: GYAE6OF01ARDXA.21.46.E02.1.454.CMB.1.raw
  modified_base (244)..(244): a, c, t, g, unknown or other
  misc_feature (244)..(244): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccacccgtggtgtcagtcgtcccaggacagacggccaggatcacctgctctgcagatggactgaccaaaagaactntagcttattcggtaaccaagagaacgccgacggccacggcccctgtacgttagngaatagtaataaagacacgtgagacgcccgtanagacgtactccgtagacgtcgaatttcgtcgtggtcctccgacgtcctacggacgggacaggccgtaagtaccgtacgttacgtacttacgtacgtaaggttcgaaacgtccgaacgggtccgaagggaacgggacgtacggtcgtaaccgtaccttacgttacgtacgtaacgtaaacgtaggttaacgacgtaaggttaacgtacggttaactaccggtaggttacggggttacgggtccgggaccggggtaaagggtacccgtaagggtcccgttacgggtaccgtacccgggttaggacccgtacggaccccgtaacggtcccgtaacccgtcccccggttacgg

SEQ ID NO: 201607 - DNA, 881 bp, Homo sapiens
  misc_feature: GYAE6OF01BYJKE.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacgaggctctggacggccttcctatgagctgacacacgccctacccgtcggtgtcaggtcgtaccccaggaccacggtaccggccgaaggactaccaccgttcgaccttcgtgacctaaggtacgttacgggacctacgaaccgaaaaaggtaaattagttacgtacctttagttaccggtaaccaaaacgaacggaaaccggaccgaaccgggacccgtaccgggtaccccgttagggtttacggtttaaggtacgttaaagtttaaacgtaaacgttaaaacggaaccgttaaccggtagggtaaccggtaccgggaccccttacgaaggtaacgtacccgtaccgtacggacgtacgttactttcgtccgtcggtacctaccgacggtacctacggaacggaacgtacggacgtaccgttaccgtaacgttacggtaactaacgttacgtacggtaacggtaaccgtacgaacggagtaacgggaacgggacggacgtagaccgttaacgttacgttaacgtacggtaacaaacggtaacgtaacgtaacggtaacgttaaggtaacgtttaaccgttagtacgggtttacgggttacgggttaccgggacggggtaaaccggtaccggtaaaccgggtaccgttaaccccggggttaccgttacccgggtaaccgtaccggtaacccggttaacccgggtacccgggttaccccgttacccggttacccccccggttaaccggg

SEQ ID NO: 201608 - DNA, 704 bp, Homo sapiens
  misc_feature: GYAE6OF01B3R27.21.46.E02.1.454.CMB.1.raw
  modified_base (137)..(137): a, c, t, g, unknown or other
  misc_feature (137)..(137): n is a, c, g, or t
  modified_base (168)..(168): a, c, t, g, unknown or other
  misc_feature (168)..(168): n is a, c, g, or t
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (484)..(484): a, c, t, g, unknown or other
  misc_feature (484)..(484): n is a, c, g, or t
  modified_base (655)..(655): a, c, t, g, unknown or other
  misc_feature (655)..(655): n is a, c, g, or t
tcagtcgtcgctcgcacgaccggtgctcgatttagactcatctacagggaaagggggtgggtccaggaggcagaactctgggtgtctcaccatggcctggactccctctacttcctcccctctcactctctgcacgnggtctctgacgcctacctatgagctacgacncacgtcccaccgtcggtncagtccggaccaggacncggacgccgtagctacnctgcctagtnacgagtacgtggacgtagaaaaccgaaagtaacgtgttacgttaactttaaggttaacggaaccaacgaaggaaccgccgtaccgtaccggaccgtcccgtggtttacggagtacgtaaataataacgttaacgacacggtagaccggaaccgtcctagtaacgacgtaccgtaccgtaggtacgcgttacgtccgttcgtacgtccttacggacggtactacggacggtaacacgaccggtagtacgtacgtntaacctagtacggtagacggttacgacgacgaggtaggaacggacggaggtactacgtagttatacgaaccgtaattacgaacgtataccgtaagtaacgtaccgtttagaggttacgggtagggttacgtacggggacgggtaaacaccgggtctaacgtacgggttacncggttaacgtaccgaaggcccgtaacggtcccgttccgaccgggttacc

SEQ ID NO: 201609 - DNA, 239 bp, Homo sapiens
  misc_feature: GYAE6OF01BYQBV.21.46.E02.1.454.CMB.1.raw
  modified_base (238)..(239): a, c, t, g, unknown or other
  misc_feature (238)..(239): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtcccaggatagacggccagatcacctgctctgcagatgactgaccaaagaaatann

SEQ ID NO: 201610 - DNA, 796 bp, Homo sapiens
  misc_feature: GYAE6OF01AXHWX.21.46.E02.1.454.CMB.1.raw
  modified_base (131)..(131): a, c, t, g, unknown or other
  misc_feature (131)..(131): n is a, c, g, or t
  modified_base (716)..(716): a, c, t, g, unknown or other
  misc_feature (716)..(716): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactttcngcacagtctctgacggcctcctatgagctgacacgacgccaccgtggtcgtcgagtcgtccccgaggacaacggccgaggactccaccgtgccgtcgtaggatacttcgattacgaaccgaaaagtattacttacgtttggttacgtaccagctaagtacgtcgacggaccgaccggtcccttagtaccgtggtaccagtccagtacgacggtacctacggtaccgaccgtacgtacccggtaccgggtacctacccgtaggacggtaccgttactttccgtaccttaccggtaccctccgttacgcccggttaacggacgggttacccgtaacgggtccgtaccccgtttaaccggttacgaaaccgtttggaccggttacgggggtacccggggtaccggtaacggggttacgggaaccgtagggttaaccgaaacggttccgttaacgggtacctttaaacggtttcgttaccggtaccgaccaacggtagtaccggtaggtacgttacggacgtacggtacgggtaggggttacgtacgggtacgggacgtacgtacgggttcctccggttagtacccggngaccgtacccgggtactccgcccggtaccccttcgggacctttcccggtacccgtacccgtcccccgttcgttaccccgg

SEQ ID NO: 201611 - DNA, 769 bp, Homo sapiens
  misc_feature: GYAE6OF01B7S8R.21.46.E02.1.454.CMB.1.raw
  modified_base (106)..(106): a, c, t, g, unknown or other
  misc_feature (106)..(106): n is a, c, g, or t
  modified_base (165)..(165): a, c, t, g, unknown or other
  misc_feature (165)..(165): n is a, c, g, or t
  modified_base (268)..(268): a, c, t, g, unknown or other
  misc_feature (268)..(268): n is a, c, g, or t
tcagtcgtcgctcgcacgaccggtgctcgatttagactcatctacagggaaagggggtgggtccaggaggcagaactctgggtgtctcaccatggcctggatcccnctacttctccccctcctcactctctgcacaggctctgaggcctcctatgagctgacacncgcccacccgtcggtgtccaggtcgtaccccgaggacacggaccggcaggactccaccgtgtcctctgacgacgagtacggactacgaaccaaaagtaaactntgttacttacgttaccggtaaccaaacggaacgaacgacccgaacggaccgacccggtaccccgttggttagttaggtacgtaaattaacgtaacgttaaaacgaccgtaacggtacgggaacgtaccgggtaccccgtacgaacggtaacggtaacctcccgtaaggaccggtaccgttaactttccgtaccggtacgggtcccctaccgaacggttccgtaacggacgggaccgacgttacggaacgtttaccgttaccggttacgtaaccgtacggttacgtaaggtacgtaacggtaccccgaagggaccgaaggaacggtacggacgtacgaaccgttactacgttacgtaacgacgtaacgaacgtagacgtaagtacggttacgtacgttaggtacggttgggtcgggtacgggacgggaacgtaacggcgtaggtaccgtccggtaccgtaaggtccccggacgtacccgacgtaccgtccccgtcgtcccgg

SEQ ID NO: 201612 - DNA, 622 bp, Homo sapiens
  misc_feature: GYAE6OF01DXBLJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatccacctgctctgcagatggactcgaaccaaagtaaatgtagctttagttacggtaaccaaacgagaacgaccgacggccaacggtcccctgtacgttagtagtaataataagtaaacgacacgtaggacgacgcctagacgaagtcctccgtagacgtcgtacttcgtcgtcggcctccgagtctacggaggacagcacgtctacgtgactagctagtacgacgtcgacgtacgaaggaggacgaggtacgtagtacttacgttactacgaaccgtaagtagtaagaaccgtagggtacgtaacgttactaggtaggtttacgggtacggttcgggtacggggaacgaccgtagtcgtacggtccgttaaccgtgacccgtacgaccggtagtcccgcccgtccccgtaccgg

SEQ ID NO: 201613 - DNA, 826 bp, Homo sapiens
  misc_feature: GYAE6OF01DD4B5.21.46.E02.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacnggctctggacgcctcctatgagctgaccacgacgccctacccgttggtcgtacacgttccggtacccaaggacaggacggtccaggactccacgtgccttcgtgaccaggtgtacggaactacgtaaccgaaaagtaaattcgtacgttaccgtttaacgttaccggtaaaccaaaccgaacggaaccggtaccgaaccgggacccggtaaccggtacccccgttaggttacggttacggttaacgtaaacttaagttaaacgtaaaacgtaccgtaacgtacggtacggaccggtacccgtagaacggaacgtacctaccggtacggtaacgtaccggttactttaccgttccgtaccggtccgtaccgtacgtaccgtaccgggtaacgggaccggtaacggtaccgtacgttacccgtaccggtttacgtaacgttacgtacggtaacggtacgtaacggaacggtacggaacggaagggaaccgggacgggtacggtacgtaacgttaacgttactttaacgtacgtaaaccaacggtaacggtaacgtaacggtacgtaaggttacgtacgttacggttaggttcggggtacggttacggggagggtacggaacgtaacgtcgtaccggtccgttaccggtcgacggtaccgttaccggacggttcccgtcccggtcccgtaccg

SEQ ID NO: 201614 - DNA, 673 bp, Homo sapiens
  misc_feature: GYAE6OF01BMVU0.21.46.E02.1.454.CMB.1.raw
  modified_base (276)..(276): a, c, t, g, unknown or other
  misc_feature (276)..(276): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacgcctctatgagctgacacacgcccacccgttcggtgtcagttcgtccccaggacaggacggccaggactccacctgctctgcagatcggactgaaccaaaagtaaatatgtacttagttacggtaaccaanaggaacgccgaacggccgacggccccttggttgttaagtagtaattaagttaaagtaaaacgcctaacggttaggaacgtacggtcccctagaaggacgtaaccttcccgtaggacgtcgtactttcctcgtcgtcctacgacgtcgtacggaacgggacacgacgtacgtaccgtacgtttacgaacttactacgtagtaacggtaacgtccgaaggcgaagggacggacggagtcgtacgtaacgttattactagtaacgaaacgtgtaacgtacgaacgttaggtacgttactaggttaggttgggttcgggtacgggacgggtaaccggacgaacgtcggaccgtaccgtcgtacggaccgacggaccgaggcccgtccggccccgttaccgg

SEQ ID NO: 201615 - DNA, 678 bp, Homo sapiens
  misc_feature: GYAE6OF01D3A77.21.46.E02.1.454.CMB.1.raw
  modified_base (172)..(172): a, c, t, g, unknown or other
  misc_feature (172)..(172): n is a, c, g, or t
tcagtcgtcgctcgcacgaccggtgctcgatttagactcatctacagggaaagggggtggtccaggaggcagaactctgggtgtctcaccatggcctggatccctctacttctcccctctcactctctgcacaggctctgaggcctctatgagctgacacagccacctggtntcagtcgtcccaggacagacggccaggactcactgctctgacagatggactggaccaaaagtaatactgactttagtcggtaaccaacagaagaccgacggccgaacggtccccgttagtacggttagtaggtactaattaataaaggactacgttaggacgacggtacctacgaagacgtactacccgtagtacgacggtaacttcgtcgtcggcctaccgtacgccgttacgacggggacctacgcgtaacgtaccgtacggttacgtacttaagtacgtaagtagtaacggttccgacggacgaacggaggaacggacggtcgtacgtaacttacgtttacgtactaacgtaaactaggttaacgaacgtaagggtacgtaacggttactcggttaggttgggttacgggttccggacggggtacggaccgtaacggtcgtaccggtaccgtacgttacggacctacggacccgtacggtcccgtcccggtccccgttaccgg

SEQ ID NO: 201616 - DNA, 675 bp, Homo sapiens
  misc_feature: GYAE6OF01EADIM.21.46.E02.1.454.CMB.1.raw
  modified_base (177)..(177): a, c, t, g, unknown or other
  misc_feature (177)..(177): n is a, c, g, or t
  modified_base (206)..(206): a, c, t, g, unknown or other
  misc_feature (206)..(206): n is a, c, g, or t
  modified_base (214)..(214): a, c, t, g, unknown or other
  misc_feature (214)..(214): n is a, c, g, or t
  modified_base (359)..(359): a, c, t, g, unknown or other
  misc_feature (359)..(359): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctctatgagctagacacagccacccgtggtntcagttcgccccgaggacagacgcaggcncactgctngcagtagtgactgaacctaaaagaatatagcttattacgacaacaagaagcgacgccgacgtcccgtagttgtacgtagaactaagtaataaagactacgtaggaagacggacctagaagtacgacgttacctagacgaacgttnttccgtacggtccgtacgtacccgacgtacccggtaaggacggaacgtacgacgttaacggttactacgggttactaccttagtacgtaagacggtaacgtaccgaacggagaacgagggtacgacggtactacggtaactttaacgtaacgtacgttaaacaacgtaaggtaagacggtaagtaacgggttacgttaagtaccgttagggttacgggtacggttacgggaaacgggtaccggtaacgtacgtaaccggtcggtaccggtacgtaccgtacgaccggacccgtagcccggttccgtcccgtacccg

SEQ ID NO: 201617 - DNA, 652 bp, Homo sapiens
  misc_feature: GYAE6OF01D3WJY.21.46.E02.1.454.CMB.1.raw
  modified_base (240)..(240): a, c, t, g, unknown or other
  misc_feature (240)..(240): n is a, c, g, or t
  modified_base (293)..(293): a, c, t, g, unknown or other
  misc_feature (293)..(293): n is a, c, g, or t
  modified_base (457)..(457): a, c, t, g, unknown or other
  misc_feature (457)..(457): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagccaccctcggtgtcagtcgtcccaggaccagacggccaggactcacctgctctgcagatggactgaccaaagaatntgtcttagttggtaccaacagagccagccaggcccctgtgttacgtgatatanaaagacactgagtacggcctagagaagtactccgtagacgcgtacttcgtctcggtctaccgacgtctacggagggacacggccgtacgtcgtacggttacgtactagttacccaggtagaacggttccccgaagggacgtaagggacggtaacgggacgggtntacggtaacctttacttaccgtagtaaccgaacgtaacgtaagaccgtaaggttaggaacggtttactacggtaggtttacgggttcggttacggggaccgggtaagggaccgtacggtacggtacggtacccggttaccgttacggtacccggactaaccccggtaggtacccgtcccggcccccgtttacggg

SEQ ID NO: 201618 - DNA, 743 bp, Homo sapiens
  misc_feature: GYAE6OF01CLS9D.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgacggcctctatgtagctgacacagccaccgtggtatcgagtcgtccccaggaccagacggccaggtatccactcgctaccgttgaccgaggatcggacgttacgaccgaaaagtaaaacttgtacggtactttagttacggtaaccaaacgacgaaacggaccaggtacccacggtaccccgttggttacggttagtaggtaatttaaccgaaaagtaaacgtaaccgtaacgtaaggtaacgaccggttaccctacgaacggtacgaccttaccccggtagtaacgtcgttaacgttccgttacggtacgcctacccgtagtacccgtacgggtaacgtacgtacggacgtacgttaccggtaactttacgaaccgttaacgtcgttaagtacggttaaacgtccgaacggtcgtaaacggtacggaaccgggtaggaccttaaggtacctttacgtaacgtcgtaaacgaagtacgtaagacgtaggttaacgacgttactgttacgttaggtcgttacggggacggttacggaacgtcggaaccgtcggtacccgttacgacggaccgtacgaaccgcgaccgtccctacccggtaccg

SEQ ID NO: 201619 - DNA, 770 bp, Homo sapiens
  misc_feature: GYAE6OF01D41HM.21.46.E02.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagactcatctacagggaaagggggtgggtccaggaggcagagctctgggaatctcaccatggcctggacccctctcctgcctccccctcctcactttctgcacagtctctgagcctctatgagctgacacacgcccaccgttcggtgtcagtcgtccccgaggaaccgaaccggccaggctccacctgctcgnggatcttcattgaaccaaaagtacttatacgtttggttacggttccagacagaacgtcacggccacggtccctaggtactcggtctactccagtcggacggcctaggtacgaccgacctaccggtccgggactcccgagacgacgtacttcgtctcgtcctacgagtccgtacggacgggtactacggtcgaccctacgttacggaacttacgttcggacggggttacccggggacccgtagggtacgggtaacgtagggtaacgaacgtcctaaggttaacccttagttaacgtttcgtaaccggaccaaccggaatacggtaacggtagtcggttaccagggttaccgggtaaggggttacggttcggggaccggggtacggtaaccggttacggttaccgggtaccgtttccggttacggtcccggtaaccggacccgggttaaccgggccccttacccccggggaccccccgggtttaacggtaccccgtttaacccggttttacccccggtttcccgggttcccccccgttacccccgg

SEQ ID NO: 201620 - DNA, 768 bp, Homo sapiens
  misc_feature: GYAE6OF01ARM3O.21.46.E02.1.454.CMB.1.raw
  modified_base (176)..(176): a, c, t, g, unknown or other
  misc_feature (176)..(176): n is a, c, g, or t
  modified_base (213)..(213): a, c, t, g, unknown or other
  misc_feature (213)..(213): n is a, c, g, or t
  modified_base (249)..(249): a, c, t, g, unknown or other
  misc_feature (249)..(249): n is a, c, g, or t
  modified_base (486)..(486): a, c, t, g, unknown or other
  misc_feature (486)..(486): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacgcctctatgagctgacacagcccaccgtcgtntcagtcgtcccgaggacagacgccaggatcactgctntgcagtagtcggtactacgaaccgaaaagtaaagtntacggttacttaacgttacggaaaccaaacgaacggtaaccgaccggaacggcccgtaccggtaccccttagggttagttaacgtaggtaattaaacgtaaataaaaccgacgttaacgacggtaacgggaccgtacccttacgaaggtaaccgtaccgtacccggtaggacgtacgttacttccgtcgtcgcctacacgtctaggacgtacgacgtacgacgtacgtacggtttanaaccgtagtaccgtaggtacgtaaccgtaccgaacggaggtaacgagggaacggtcggtaccgttaactaaacgtttacttaaccggactaaaacccggtaagtaacggtaacggaaacttacggggttaaacggtacggttacttaacggtggggtttaccgtggggtaacgggacgggtaaccggaaggttaccgtaccgttaccgggtaccgtaaccgttaccgggtactaccccggaacgggtaccctccccgggttaacccgtccccggttaaaccg

SEQ ID NO: 201621 - DNA, 676 bp, Homo sapiens
  misc_feature: GYAE6OF01CKHYB.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatccacctgctctgcagatggactgaccaaagaatatgtactttagttcggtaaccaacagaaagccgaaggccgaacggccccctggttgtacgtgtatataagtaaaggactacgtagacgacggccctagagagactcccgtgacgacgtatttccgtcgtcggcctaccgagtccgtacgagggaccaggctaacggttccgaacgtttaggaacctttagtaccggaagtacggtaaacgtccgaacgggacgtaaagggacgggaacggacggtaccgtaggtaacctttaacgtttaccgtagttaaaccgaaacgtaggtaacgacgtaacgggtagtaacggttacctagtacggttagggtcggtcgggacgggtaggaaccgtacggtcgtacggtaccggttaccgtaacggaccgaccggaacccgtaggtacccgtcccggcccccgttacggg

SEQ ID NO: 201622 - DNA, 816 bp, Homo sapiens
  misc_feature: GYAE6OF01C60HL.21.46.E02.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagactcatctacagggaaagggggtgggtccaggaggcagaactctgggtgtctcaccatggcctggatccctctacttccttcccctccctcactctctgcacaggctctgacggccttcctatagagctgacgacacgcccacccgtcggtcgtcacgtcgtcccgaaggacgacggaccggccgaggtacncctaccgtgtccttcgtgtacgaagtcgtacggtaccgtaacgaaccgaaaaagtaacttagttcgtacgtttaacgttacggtaaacctaaacgaacgaacgcccggtaacggaccgtaccggtaccccgttaggtttacggttacggtttagtaagttaaacgttaaacgtaaacggtaaccgtaagtacgggtaaccggtaccggtacccgtaacgacggtaacgtacccgtccgtacggacggtacgttaccgttcgtccggtcgaccctacgtacgaccgtacggaacggaccgacgtcgtaaccggttacgtaccggtttagaaccgttaacgtacgaaggttacgtaaccgtcggaacgtaacggaacgggtaaccggaacgtacgggtaacgtacggttaacctttacgttaaacgtaccggtaaactaaccggaagtaacgtaacggttacgtaaggttaccgttacgtatttcgggttagggtccgggtacggggacggaccggtacgtacgtacccggtacggtaccgaccggttacgaccgtaccggaacggtccgccggtcccgtcccggttaccg

SEQ ID NO: 201623 - DNA, 808 bp, Homo sapiens
  misc_feature: GYAE6OF01EQQHS.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccacccgtcggtgtcagtcgtcccaggacaggaccggccaggactccgactgctctgacagtagtcggtacctacgaaaccgaaaagtaaattagtcgttactttaaggtttaccggtaaccaaacgtaacggaacgaccgtacggacccgtaaccggtccccgttaggttacgttaacggttacgaaagtttaaacgttaaacgtaaaacggtaccgtaacggttacgggaaacggtacccgggtacccctaaggaacggtaacgtaaccgttaccccgtaaggaaccggttaccggttaacgtttccgttacgtcggacccttaccgacggtaccgtacggaaacgggacacggtacgtacgtacgtacgttactacgtactacggagtacggtaacggtacgaggtacgaagggaacggacggtacggacgttacgtaacgtttaacgttacgaacgtaaaccgtaaagtacgtaacggtaacgtagggttaaacggtacgttaaccgttggttaggggtttcggggttaccgggtacgggtaaccgggtaacgaacccggtaagtaccggtaccggtacccgggttagaccgaccgaacccgggtcgaaccggtccccgtcccgtacccggttacccgg

SEQ ID NO: 201624 - DNA, 646 bp, Homo sapiens
  misc_feature: GYAE6OF01BI1SY.21.46.E02.1.454.CMB.1.raw
  modified_base (289)..(289): a, c, t, g, unknown or other
  misc_feature (289)..(289): n is a, c, g, or t
  modified_base (503)..(503): a, c, t, g, unknown or other
  misc_feature (503)..(503): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgccaccctcggtgtcagtcgtccccgaggacacgacggccaggactccacctgcctcgtcgacagacgtggactgaaccaaaagtaaatagtcgtactttagttcggtaaccaacgaagaacnccgacggccacggtccctggttcgttagtgataataagtaaacgactacgtaggacggtacggtacccctacgagaacgtacctcccgtagacgtcgtacttcgtcgtcggtcctacgagtcgtacggacggacacgtactacgtaccgtacgttcgtaacttagtaccgtagtaacggtacgtacggacggacaagggacggtacgaggtacncgtaatacgttactgaacaacgagtaagacgtagtaggtacgtctacgtagggtttggtacggtcgggaggaacggacgtacggtcgtacggaccctacggagaccgaccgacccggaggtcccgtcccgtacccggttaccg

SEQ ID NO: 201625 - DNA, 680 bp, Homo sapiens
  misc_feature: GYAE6OF01EYSYF.21.46.E02.1.454.CMB.1.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtggggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcacctgctcngacagatggactnaccaaaagaatntcgtactttagtcgtaccagacaagaacgccgaggccacggtcccctgttagttaggtacgatattaaagtaaacgacctactggaagacggtccctagaaggaacgtacttcccgtagacgtacgtacgttctcgtcggtctaccgacgtctacggacgggacaggtcctagtacgtacggtttagaccttagtacgtagtaacggtaaacgtacggaacggacgtaacgggaacggacgggtacggtacgttaacgtaacgtttaactttacgtacgtaaacgaaacgtaggttaaccggaacgtaaggtacgttaaacgggtaccttacgggttaggttcggggttaggtaccggggacgggttacggaacgtaggacgtacgggtacccgttcgaccggtacgacccggacgtcggcccgtcggtacccccg

SEQ ID NO: 201626 - DNA, 851 bp, Homo sapiens
  misc_feature: GYAE6OF01A7Y4Z.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaaggactccacctgctctgcagagtggactcgaaccaaaagtaaatatgtactttaagttacggtaacccaaacgaaggtaacgccgaaggcccgaccggtacccccttaggttaggttagtagtaagttaataaagttaaaacgaacctaacgtagggaacggaaccgggtcccctagaaggtaacgtactccccgtaggacgcgttacttcctcggtcgcctccgagtcctacggaaggtaccagcgtagtaccgtagttacgattacacggtaagtacggtaacgtacgaacgggtacgaaacgggaacgggacgtacgggtaccgttaacggtaaccttaacggttttacgaacgtaaaccgtaaaacggtacgggttaaacggtaaacgtaaacggggttaaagggtaaccggtttaccgtttaacgggttacgggggttttaacggggttacccgggggtttaccggggaacccgggggttaaaaccgggggaaacccggttaaccgggtacccggtttaccgggggtaaaacccccggttttaccgggttaacccggggtaaacccgtaaccccgggtaacccccgggtaaccgggtcccccgttaccccccgggttcccccccgggtttacccgggg

SEQ ID NO: 201627 - DNA, 705 bp, Homo sapiens
  misc_feature: GYAE6OF01A9Y1S.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccgaggacagacggccaggactcacctgctctgacagatggactgaaccaaagaatatgtactttaagttcggtaaccaacgaacgaacgccgacggaccgtaacggccccttaggttacgttaaggtgtaaattaagtaaataaaacgactaaccgtggaacggacggcctagagacgtactcccgtgacgcgttattcgtcgtcggcctcacggtcctacggagggaacccaggtaccgaacgttccgtaacgtttagtacttaacgtacgtaaggtacgaacgttacccggaaggtacgaacgggacgggaacgacgggtctacgtaacgttagtttacgtacgtaacaacgagtaagaacggtagtaacggacgttacgtacgttagggttcggggttcgggtacggggacgggtaaccggtaacgacgggttacccgacgggttaaccccgccggtttaggacccgtaccggacccggtaacggtcccgtcccggtcccggttacccggg

SEQ ID NO: 201628 - DNA, 844 bp, Homo sapiens
  misc_feature: GYAE6OF01A46UD.21.46.E02.1.454.CMB.1.raw
  modified_base (137)..(137): a, c, t, g, unknown or other
  misc_feature (137)..(137): n is a, c, g, or t
  modified_base (266)..(266): a, c, t, g, unknown or other
  misc_feature (266)..(266): n is a, c, g, or t
tcagtcgtcgctcgcacgaccggtgctcgatttagactcatctacagggaaagggggtgggtccaggaggcagaactctgggtgtctcaccatggcctggactcctctacttcctcccctcctcactctctgcacgnggctctgacggtcctcctatgactcgtcgaacacgaccgtaccctaccgtcgggtgtccgtacggttccgacccgacggaacgaacggtaccggaccgaaggtactaccgaccgtcgtaccttcgtcgntaaggcgaccgggtacctacgaaaccgtaaaagtaaactcgttacgttacgtttacggtttaaccgaaaccgaaccgaggaaccgaccggaccggaccgaccggttacccgttggttaccggttagtaagtaacttaagtaaaacgtaacgtaaaccgcgtacggaacgaaccggtcctaacgacggacttaaccgcgtacgaacgtctacgttcgacgttcggacctacgacgtcggaaacgcgggaactacggtacgtaaccgttacgggttaccaacgttaccgttacgtaacggttaacggtaacgggtaacgtaccgggaacggaaccggtaagggaaccgggtacgtaaccggtacgtacggtaaactttattaacggttaacgaaccgttaaagtaacggaactaacgggtacggttaaacggtagttaccgtaagggtttaccgggttcggggtaacgtaccggggtaaagggaacgtaccgttacgggtaaccgtccggttaaccggtacgtccggaaacggtacccggtaccgtaacccgggtcccaaaccggggtccctttaccggg

SEQ ID NO: 201629 - DNA, 704 bp, Homo sapiens
  misc_feature: GYAE6OF01CB5LF.21.46.E02.1.454.CMB.1.raw
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (278)..(278): a, c, t, g, unknown or other
  misc_feature (278)..(278): n is a, c, g, or t
tcagtcgtcgctcgcacgaccggtgctcgatttagactcatctacaggggaaagggggtgggtccaggaggcagaactctgggtgtctcaccatggcctggatccctctacttctcccctcctcactctctgcacaggctcgtgaggcctcctatgagctcgacacagcctaccgtcggtgtcaggtcgcccaggacacggacggccaaggctcgacctgcttcgngcacgtancggactcgaacaaaagtatactcgtactttaattcggaaccaanaggaacgccgaacggccacggtaccctggtacgttacgagtaacttaagtaaacgtaaacgaacgtacgtaaggacggaacggccctagaacggtacgtaccgtccccgtaggtaacggaccgttaacgtttcgtacgtcgggtactacccggagtccctaggacgggtacagtccctaggtacctacgtagtacctagtacaggtagaacgtacacggacgaaggtaacggacggacgtacgttacgaaccgtttagttaacgtaacgttaccgaaaaacgtggttaaccgtaacggtaagttaacgggtaacgttacccgtacgttaggttcggggttaacgttacggggaacggacgggtaaacacggtacgtacgtacggtccgtaagaccgtacgaccgtaggccgtccgtcccggtaccg

SEQ ID NO: 201630 - DNA, 778 bp, Homo sapiens
  misc_feature: GYAE6OF01BQEMP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggaccagaccggccaggactcacctgctctgcagatggactgaccaaaagaaattatgtctttagttcggtaacccaaacgagaacgccgacgggccaacggtcccccttaggttgttagtgtaatataataaagacactagagacggtccctgaagagtactcccgtgacgtcgtacttctcgtggcctccgacgtcctacgacgggacacgaccgtacgttaccgtaccggtttacgtaacgttaacgttaccggtaacgggttacgggtaaaccgttacccggaaacgggaccggtaaagggaaccggggtaacgggaacgggtttaccgtaacggttaaaccgtttaacctttaaaccggttaccgtaacgtaaaaacccggttaggttaaaccgaacggtttaacggtaaagggttaaccggtttaactaccggttaagggtttttacggggttacgggtttaccggggacgggtaaaccggggaaccgacgggttacccggtaccggtaccccggttacgtaccggtaccgaaccggtaccccgaaacgggttcccgtaccccggtcccccggttaccccgg

SEQ ID NO: 201631 - DNA, 863 bp, Homo sapiens
  misc_feature: GYAE6OF01DQAHB.21.46.E02.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcacctctctgcacaggctctgaggcctcctatgagctagacacagcccacctcggtntcagtcgtacccaggacaggacggccaggactccaccgtgcctctggcagagttcggactacgaaccgtaaaagtaaattcgttacgtactttaaggttaccggtaaacctaacgaacggaacgacccgtaaccggaccgtaccggtccccgttaggttaggtttaacggtacgtaattaaagttaaacgtaaaaacggaaccggtaacgtaggaaaccgggtaaccggtaccccgttaacgaacggtacgtaacctacccggtaggaacgtaccgttactttactaccggttcgcccgttacgtacgtccgtacggtaacggaccgtaagccgttaggtacccgttaaggtttaccgtaataaccggttagtaaacgggttcggtaaaccggaccggtaagggtaacggaacgggtaacggggacggttaacgggtctaaaccggttaactttaacgttaacggtaacgttaacaaacggtaacgtaacggaaacgttaaggggttacgttaacggttacgttaacggttagggttttacgggttacggggtaccgggaaacggggtaaaccgggaccgtaacgggtaccgttacccgggtaaccggtacccgttaacggtacccgtaacccgggacccgttaaaccgggcccgtaaacccgggttcccccgttaaccgggg

SEQ ID NO: 201632 - DNA, 762 bp, Homo sapiens
  misc_feature: GYAE6OF01DOPKY.21.46.E02.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctctatgagctgacacacgccacctggtntcagtcgtaccccgaggtacaggacggccgaggactccaccgtgcctcgtgacgagtatcggactacggaacctaaaagtaaatctgtacttagtacgtaaccaacgtagaacgccgtacggaccgacggccccttggttacgttaggtataataacgtaaagtaaacgtaaccacgtacggtacggaccggtaccctagaacggtactaccgtacccgtaggacgtaccgtaactttccgtacgtccggtccttaccgacggtccgtacggtaacgggacacgtacgtaccggtacgtaacgttagtaacccttagtacggtaacgggtacgtaaccgacggtaaggaccggagggtaacgggacggtacgtccggtaacgtaacgtttattaacggtacgtaaacgaacgtacggtaacgaacggtaagggtaccggttaaacgttacgttacgtgggtttacgggtcggttacggggaaccggtaacgggtaccgtacggtacgtaccgggtacccggttacggttaacgggtaaccgtacccggtaacggtccgttcccctaccccgggttgtaaccccgg

SEQ ID NO: 201633 - DNA, 902 bp, Homo sapiens
  misc_feature: GYAE6OF01BDA8S.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtgtcagtcgtccccaggacaggaccggccaggactccacctgctctgcagagtggactagacaaagaatgtgtacttagttacggtaaccaaacgaagaacgccgacggaccgacggtccccttggttacgttaggtagtaattaagttaaacgtaaagtaccaacgttaggaacgtaccggtcccctagaggtaacgtactccccgtagacggtcgtaactttccgtcgtcgggcctaccgacgtccgtacggaacgggtaccacggtaccgtacggttaccgtaacggtttacggtaaccgttaacgttacgtaaggttaacggtaaccggtacccgtaaaggggtacccgaaagggtaaccggggtaacggtaaccgggttacttaaccggtttaaccgtttaaacgtttaaccggttaacggtaaacccgtaaaacggttaacggttaacgggtaaaccggtaaacgggttaacgggttaaccgggtttaaacccgtttacgggttaacgggtttaggggggtttaccggggttaaacccgggggtaccgggggtaaacggggtaaccccgggtaaacggggttaccccggtaaaccccgggggtttaccccggttaacccggggttaaacccgggtacccggtaaaccccggggtaacccccgggaaacgggtttccccccggttaccccccgggttaccccccggtttaccccgggg

SEQ ID NO: 201634 - DNA, 733 bp, Homo sapiens
  misc_feature: GYAE6OF01B8F8P.21.46.E02.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctcctatgagctgacacngccctacccgtggtntacagttccgtccccgaaggaccaggaccggccgaaggactccacctgccttctgcagatcggactagaccaaagaatgtcgtattagttcggaaccaagagaagccgacggccgacgcccctggtagtagtagacgtataagtaagacactgacgtacgcctagagacgtactaccgtagagcgttacttcgtcgtcggtacctccgaggtcgtacggaacgggactaacgggactaggttaccgtacgttactaaccgttacgtacggtagttaacggaacgttaccggaaggtaacggaaggtaacgggacggtaacggtacgttaacggtaacctttaacgttaacgttaacggtaaacctaaaacggtacggttaaacgacggtaacgggttaaaggtaacggttactacggttagggttacgggttacgggtaccgggtacgggaaacgggtaaccgtaacgggtcccgttaaacggtcccggtaaccgttacggttaaccgaccggtaaccggtacggtacccgttcccgggtcccccgttaaacggg

SEQ ID NO: 201635 - DNA, 807 bp, Homo sapiens
  misc_feature: GYAE6OF01BKRQC.21.46.E02.1.454.CMB.1.raw
tcagtcgtcgctcgcacgaccggtgctcgatttagactcatctacagggaaagggggtgggtccaggaggcagaactctgggaatctaaccatggcctggacccctctcctgcctccccctcctctactttctgcacagtctctggacggcctcctatgagctgacacacgcccaccctcggtctacaggtccggtacccccgggacaaaccgggccaggactccaccgtgcctcgtggagatgactattacgaaacctaaaaatttgtttggtttttacgaaccagtacaagtaacgtcgacggaccgtaaccggtccccttagggttcggttacggtacctacgttaccgtaggttaacgggaacggtaacggaacgggaaccggtaacccggtaacccccgggtaccgggtaaccgttcccggtaaggacggtaagttacgtttacccgtcgtaccggtacctaccgtaacggtcggacgggtacggtcgtaccgtacgttgtacgttcgaggtacgggcgggtaccgagggtaggacgagtacgaagtcgtaacgtactacgttacgtacttacgacgacgacgagacctaggtacgtacgggtctacggacgggtacggacgggtcgtaggtcggggaacgggtacggtacggttacgggttacgtaccggtaccggtacggtacgacccggtaaccgtaccgggtaccgtacccgggtacccccggttagggtacccttacccggttacccgttacccggttcccccgtaacccgtttccccgttccgttcccgttacccg

SEQ ID NO: 201636 - DNA, 742 bp, Homo sapiens
  misc_feature: GYAE6OF01A4JWN.21.46.E02.1.454.CMB.1.raw
  modified_base (178)..(178): a, c, t, g, unknown or other
  misc_feature (178)..(178): n is a, c, g, or t
  modified_base (255)..(255): a, c, t, g, unknown or other
  misc_feature (255)..(255): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctctatgagctagacacacgcccacccgtggtntcagtcgtccccaggacaggaccggtccaggtactccaccgtgctcgtgcagtactcggactgaaccaaagaacttntacgtacttattaccggtaaccaacgacgaacgtccgacggacccacggtccccttaggtagttagtagtaactataacgtaaacgactacgtaggacgtaccggtacctacgagtaacgtcctaccgtagacgtcgttaacttcgtcgtcggtacctacgacgtccgtacggaacggtaccacgtccgtacgttaccgtaccggttactaacgttacgtaccgtaggtaacgtaaccggttaccggacgggtaaccgtaacgggacggtaacggacggtacgtaccgtaacgtttacttacggtacgtaaccgaaagttacggtaactaggttaacggtaacggttacggttaccttaagggttcgggttacgggttccgggtacgggacgggtaaccggtaccgtaccggtggtacccggttacggtcccgtaagggccctaccgggacccttaacgggcccctcccgggtacccccgttaacgg

SEQ ID NO: 201637 - DNA, 808 bp, Homo sapiens
  misc_feature: GYAE6OF01ESQSV.21.46.E02.1.454.CMB.1.raw
  modified_base (349)..(349): a, c, t, g, unknown or other
  misc_feature (349)..(349): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcacctgctctgcagatggactggaccaaaagaaatatacgtactttattggtaaccaacgaaggaaacgccaaggccaacgggcccccttggtagttaagtggaacttataacttaaagacacgttaggacgacggtccctanagagtactccctagacgtcgattctactggaccttcgagtcccgtacgaacgggaccagtcgtacgttccgaacgtttcgaacttacttacgaacggttacgtaaacggttaccccgaaggaccgaaacgggaaggaaccgggaacgggtaccgttacggtaaccgttaacgttttaaccgttacggttaacccgaaaacgtaaacgggttaaaccgaaaccggtaacggttaaacggtaacggggttaaccgttaccgtaacggttttacggggggttaccggtttacccggggtaacccggggtaaacggggtaacccggaaaccgggtaaccggttaccgggtaaaccccgggtttaccccgttaaaacgggggttaccccgtaaaccccgggtaacccccgggtaaaacgggtacccccggttacccggtccccccccccgggtttaacccgggg

SEQ ID NO: 201638 - DNA, 786 bp, Homo sapiens
  misc_feature: GYAE6OF01EBYKP.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttcctcccctcctacactctctgcacgaggctctaggacggtcctcctagtcgagtctacgaccacaccgccctaccgttcggtcgtcgacgtccgtacccgaggacgacggaccggaccgaaggtacctaccgtaccgtcgtccgtcgtacggacgagtacggtacgacgtacgaaaccaaaagttaactagtcgtacgttaacgtaacggaaaccaacgtacgaaccggaccgaccggacccgtaccggttccgttaggttaggttaagtaagtaactaaacgttaaacgaaacgtaaccgtacggtaacggtaccggtaccgtaccgtaggaacgtaccgtaccggtacgtaacggtacgtacgttcgtcgtacgtccggtaccgagtacgcgtaacggacgtacgcggtacgtacgtacgtacgtacgtacgtacgtacgtacggtacgtaacggcggtaaggaacggacggacggtacgacgtacgtacgtacgtacgtacgtaactaagtaacgtaaggtaagtaacggtaagtaaggttacgtacggttacggttagggttacgggtacggtaacgggacgggtaccgggtacgtaccgggtacgtaccggtaccggtacggtacggtacccgtaccgggaccgtaccggtcccgtcccggtaccctcgg

SEQ ID NO: 201639 - DNA, 655 bp, Homo sapiens
  misc_feature: GYAE6OF01B450Y.21.46.E02.1.454.CMB.1.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccaaggacagaccggccaggactccacctgctctgcagntggactgaccaaagaatntgcttatcgtaccaagagagccaggccagccctgtgtangatatataagacacgtgacgacggccctagagacgtactcccgtagacgtcgtattccgtcgtaggcctccagtcctacgacgggacagccgtagtccgtacgttacgactaacttcgtacgtacgtaacgtccgaacggacgaaggtaacgggacgtaacggtccgtacgtacttaacgtttaccgtacgttaaccgaaacgtcgggtaacgaacgtaacgggtaacgtacgggttaccttacggtagttttcggggtacggtttccgggacggggaacggtaccgtacggttaccgtacggtaccccgttacccggtacggtaaccgaccggtacccgaacggtccccgtcccggtcccccgtaccgg

SEQ ID NO: 201640 - DNA, 912 bp, Homo sapiens
  misc_feature: GYAE6OF01EGJPF.21.46.E02.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtcgtcacgtcgtcccgaggacagacggccaggactcgactgctcngcagagtggactacgaccaaaagtaactagtgtactttaagttcggtaaaccaacgaagaacgccgacggaccacggtcccctaggtttacgttaaggttactaattaagtaattaaaaacggactaccgtaggacggtaccggcctacgtaagacgtacttcccggtaggaacgtcgtaactttccgtcgttcggcctacctacgtaccgttacggaacgggtaacgacgtaaccgtaacggttacgttacgggtttaacggtaacctagttaaccggtaacggttaacggtaaaacccggttaccggacggggaacgaaccgggggaaaacgggtaaccgggtacgttacccggtttaaacgggttaccgtttttaaaccgttaaccgtttaaccggtaaaccgtaaaaaccggtaacggtttaacggtaaaccggttaaagggtttaaagggtaaacccgggttttaaccgttaaaccggttttaggggttttacgggggtttaccggggttttaaaccggggacccggggggtaaaagggttaaacccccgggtaaacggtttaaccccgggttaacgggtttaaaccccccggtttaccggggttaaccgggtaacccggtaacccgggaacccgggttaaccccggttccggtcccccccgggtaaaccccggttttcccggg

SEQ ID NO: 201641 - DNA, 750 bp, Homo sapiens
  misc_feature: GYAE6OF01DJPD6.21.46.E02.1.454.CMB.1.raw
  modified_base (457)..(457): a, c, t, g, unknown or other
  misc_feature (457)..(457): n is a, c, g, or t
  modified_base (489)..(489): a, c, t, g, unknown or other
  misc_feature (489)..(489): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggccttcctatgagctgacacacgccaccctggtgtcagtcgtcccaggaccaggaccggccaaggactccacctgcttcgtgccgagtacgttggactagaaccgtaaaagtaaagttattcggtacttttaagttacggtaaaccaacggaacgaacggacccgacgggacccgtacggtccccgttaggttagttaaggtacgtaattaaacgttaaataaaacgactacgtaggacggaaccgcctagagaacgtacctaccgtgacgtctatttcctacgtcgactccagtcacggacggacacggntacgtcgtacgttagactactacgtaggttanaacggttacgacggtaacgagggacgggtaacgggaggtacgttaaccgtaatttaacgtttacggtagtaaacccgtaaagtaagaacgtaaggtaacgggttaacgtaaggtttacccgttaagttgggtttacggggttaccggttacgggaccggggtaaacgggacgtaacgttacgggtaaccggttacccggttaacggtacggtaccgtaacccggaacccggtacgttcccgggcccccttccgggtacccg

SEQ ID NO: 201642 - DNA, 762 bp, Homo sapiens
  misc_feature: GYAE6OF01CZMQJ.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctctatgagctgacacagccaccctggtgtacagtcgtcccaggacacgacgcaggatccactgctcgtgcagtatggactgaaccaaagaaatntgactttaagttcggaaccaaacgagaacgccaacggccgtaacggcccttaggtacgttagtagaataactaagtaaacacgtacgagaacggtaccgtcccagaagtaacgactacccgtggaacggtacctacgtttacgacggttcggccttaccgaacgttacgcgaacgggaccttagccgtagttacgtaacggttacgaacttaacgtacgtaaggttacgtaaccggacggttaacgaacgggtaaggtaacgggacgtaaacggtccgtacggtaaaccttaacgtttaacgtaacggttaaaccaaacggttaagtaacgaaaccgtaagggttaacggtacggttaacccgtaaggttaggtttacgggtacccgggtttaacggaaaccggggttaacggaaaccccggtacgggtacccgttacgggttaaccccgtaacgggttaccgaaccgttacccgggaaacccgtaccggtaaccgtccccgttccccggttaacccgg

SEQ ID NO: 201643 - DNA, 839 bp, Homo sapiens
  misc_feature: GYAE6OF01DP3J5.21.46.E02.1.454.CMB.1.raw
  modified_base (84)..(84): a, c, t, g, unknown or other
  misc_feature (84)..(84): n is a, c, g, or t
  modified_base (529)..(529): a, c, t, g, unknown or other
  misc_feature (529)..(529): n is a, c, g, or t
  modified_base (636)..(636): a, c, t, g, unknown or other
  misc_feature (636)..(636): n is a, c, g, or t
  modified_base (642)..(642): a, c, t, g, unknown or other
  misc_feature (642)..(642): n is a, c, g, or t
tcagtcgtcgctcgcacgaccggtgctcgatttagactcatctacagggaaagggggtgggtccaggaggcagaactctgggtntctcaccatggcctggacttccctctacttcctccccctctcactctctgcacaggctctgagtcctctatgagctgacacgtacgccctacccgtggtctacgagtccgtacccgaagggacctacgggaccgccaaggtacctaccacccgtggccttcgacgacaggtacttcgggacctacggaacctaaaaagaacttcgtacgtacgtttagttaacgggaacccaaagaacgtaaccggcccgtaacgggacccgtaccggtccccgttaggtttaggttaaggtacgtaagtaaattaaaacgtaaccggtaaccgtacggtaaggaacgggtaaccgtaccctaagggactacggaaccttcccgaaaggttacgtacggttacctttccgacggttacgggtacctacccgtaacggtccgtaagggccggtaanacgggtaccgttaggtccgttaccgttatacgtactacggtaggtaacgtacgtacggaaggtcgaaggtacggaccgtaggtatacgtagttactagtacgtaaanaacggntaacgacgtacggtaacgtacgttacgtacgttagggttacgggtacggtacgggaccggggtaacgtaacccgggtacggtaacccggttaccggggtttaaacccccgttccggggtaaagggtttaccccggaaaacccggtacccccgggtaacggttacccggtcccccccggtttacggggtaaaccccgg

SEQ ID NO: 201644 - DNA, 640 bp, Homo sapiens
  misc_feature: GYAE6OF01BEWH6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgcagatggactgaccaaaagaatatgtcttattacggtaaccaacagaacgcaggtcacggtcccctgtacgttagtgatatataaagacactgagacgccctagagacgactccctgaacgcgtacttcgtactcggcctaccgacgtcctcgaacggggacagctacgtacgtacgttagactagtccgaggtacgaacgtccgtaaggacaaggtaacgggacgtaggtacgtacgtaacttacttacgtacgtaactaacgtagtaacgaacgtaaggtaacggtacggttaactcgtaggttcgggttacggtaccggggacgggaacgggtaaccgtaacggtacgttaccggtaacccggttccgtaacggtaccgtaaccggacccgtaaggcccgttcccggcccccgttccgg

SEQ ID NO: 201645 - DNA, 679 bp, Homo sapiens
  misc_feature: GYAE6OF01B0HXJ.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatntgtcttattcggtaaccaacgaagaacgccgacggccacggcccctgtgttagtgaatataagtaaagacactagacgacggccctagagacgactcccgtagacgacgtagttctcgtcggcctaccagtccgtacgagggacacgcgtacgtacgtacgttagtaacttatacgtaggtacgtaacgtaccggaggacgaaggtaacgggacggacgtcgtacgtaactttaacgttacgtagtaaaccaaacgtaggttaacgaaccgtaagggtaacgtacggttaacttaggtacgggtttaggggttccgggttaacgggaccgggtaagggtaaacccgagggttaccgtaccgggtacccgttaccgggtaaccggtaccggtaaccgtaccccggtaacggtccctaccccggtcccccgttaccggg

SEQ ID NO: 201646 - DNA, 752 bp, Homo sapiens
  misc_feature: GYAE6OF01DEY1G.21.46.E02.1.454.CMB.1.raw
  modified_base (187)..(187): a, c, t, g, unknown or other
  misc_feature (187)..(187): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctcactctctgcacgaggtctctgacgtcctcctatgagctagacacacgcccacccgtcggtntacgaggtccgtaccccgagggaccaggaccggccgaaggtactccaccgtgcctctgacagtgtcggactacgaaccgaaaagtaaatcgtgtacgtttaagttacggaaaccaaacgaacggaaaccgaccgacggtacccgaccggtcccctttaggtaggttaaggtgtaaattaaattaaacggtaaacgaacgtacggtacggaacgggtaccggtccccgtaagaacggtacgtacctacccgtaggacgtaccgttacttttaccgcgtcgggtaccctacgtaccgtaccgtacggaaacgggactacgacgttacggttaccgtacggttagtaaccgttaagcgttaacggttaacgaacggtcggacgacggaaacgggacgacgggtacgtcgtaacgtatttaacgtacttaacgaactaacgaagtgaaactagggtacgtacggttacttaggttaggttcgggtacgggttacggacgggaacgtacgacgtccggacgtaccgttacgacgacgtacggaccgtacgtcccgcccgttcccgtacgg

SEQ ID NO: 201647 - DNA, 673 bp, Homo sapiens
  misc_feature: GYAE6OF01BDUPX.21.46.E02.1.454.CMB.1.raw
  modified_base (169)..(169): a, c, t, g, unknown or other
  misc_feature (169)..(169): n is a, c, g, or t
  modified_base (248)..(248): a, c, t, g, unknown or other
  misc_feature (248)..(248): n is a, c, g, or t
tcagtcgtcgctcgcacgaccggtgctcgatttagactcatctacagggaaaggggtggtccaggaggcagaactctgggtgtctcaccagtcggacctggactccctctacttcctcccctctcactctctgcacaggctctgacggcctcctatgacgctgaccacncgccctaccgtcggtgtacgacggttccgtccccgaggaccacgggaccggccgtaggacctccgaccgtcgccttcgngccgtaagcgtacggacctcgaacaaaagtaatcgtgtacttagttacgaaccaacgagacgaccgacggaccgaccggtccctgtacgttacgtataataagtaagtaacgacgtagtaggacgaccgtcctagacgacgtcctcgagacgctacttcgtcgtcggtctccgagtccgacggtacggaacgcgtacgtacggtccgtacgttacgaccgttagtacgagtaacgtacgaccggagagggaacgtacggcggtaccgtacgtaactaccttagttacgtacgaaactacgagtaacgcggaaggtaacgtacgttaggcgtttacggggtggtaccgggtaggggacccggtaggtaaccgcgtaccgtacggcgttacgaccgacgtccgaaccgcgtcccgtccgtccgtccg

SEQ ID NO: 201648 - DNA, 941 bp, Homo sapiens
  misc_feature: GYAE6OF01B6QFK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggccctcctatgagctgacacacgcccacccgtggtgtcgagtcgtcccgaggaccacggaccggccaggactccacctgctacgtgacagtagtcggactacggaccgaaaagtaaacgttacgtagtacgttttaagttacgggtaacctaaacgaacggaacggacccgaacggaccgtaaccgggtcccccgttagggttacgtttagtaggtaaactttaacgttaaaagtaaaacgaaccgtaacggtaggaaacggaccggtaccccgtacgaagtaccgtaccgtaccccgtaggacgaccgtttacttccgttaccggtcggtacccgtaccgtaaccggttcccgtacggtaaccgggacgtaacggtaccgtacggttaaccgtaaccgggtttaaccgtaaccttaaccggtaaccggttacgggtaaacccgtaccgggtaacggaacgggtaacggtacggggaaacggtaccgttaccggttaacgttaaaccgttaacgtttaacgttaaacccggttaaacgtaaaacggtaacggttaaaccgggtaacgtaaacgggtaacgggtttaaccggtttacgtaaccgggttttaagggtttcggggttaaccggggttaacgggggtacccgggaaaaccgggttaaccggtaaacccggggtcgttaaccgggtaacccccggtttaccgggttaccgggtaacccgtacccggtaacccgttaaccccgggtccccggttacccccgggttcccccggttaacccggttacccccgg

SEQ ID NO: 201649 - DNA, 724 bp, Homo sapiens
  misc_feature: GYAE6OF01B9BGQ.21.46.E02.1.454.CMB.1.raw
  modified_base (159)..(159): a, c, t, g, unknown or other
  misc_feature (159)..(159): n is a, c, g, or t
  modified_base (189)..(189): a, c, t, g, unknown or other
  misc_feature (189)..(189): n is a, c, g, or t
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
  modified_base (551)..(551): a, c, t, g, unknown or other
  misc_feature (551)..(551): n is a, c, g, or t
  modified_base (632)..(632): a, c, t, g, unknown or other
  misc_feature (632)..(632): n is a, c, g, or t
  modified_base (703)..(703): a, c, t, g, unknown or other
  misc_feature (703)..(703): n is a, c, g, or t
tcagtcgtcgctcgcacgaccggtgctcgatttagactcatctacagggaaagggggtgggtccagggaggcagaactctgggtgtctcaccatggcctggatccctctacttcctcccctcctcactctctgacagaggtctctggacgcctacctangagctagacacgacgaccctacccgtggtncgtaggtccgacccgaggacgacggacggccgaagctccaccgtcgctacgnggacaggtagtacggactacgaaacaaaagtattntacgtcttagtacgaaccgaagagtacgcgacggtccgaccggtccttaggttacggtagtagtaattaaagaacgtaaacgtacgacgtaaggaaaccggtccgtaccctaaggaacggtacctacgttaccggaggtacggtccgttaacgttccgtcgtaacccggccacggtacgtcggaaggaacgtaccgaggtaaccttcgtacggtacgtactaccgtaagtacgtacggtaaggtaacgcgggtaacgagggaaaccggaggacgnggttaacgacttagtaacggtactacggtaaacgaacggtaagtaacggaaggtacggtactaggttaagcgtttaggggnggtacgggaaggtacccggaagtcgggtacctacgggtacctcgtaccgacgaccggtactaccgggtacnccccttaccggcttaacccgg

SEQ ID NO: 201650 - DNA, 746 bp, Homo sapiens
  misc_feature: GYAE6OF01C4NVV.21.46.E02.1.454.CMB.1.raw
  modified_base (125)..(125): a, c, t, g, unknown or other
  misc_feature (125)..(125): n is a, c, g, or t
  modified_base (254)..(254): a, c, t, g, unknown or other
  misc_feature (254)..(254): n is a, c, g, or t
  modified_base (526)..(526): a, c, t, g, unknown or other
  misc_feature (526)..(526): n is a, c, g, or t
  modified_base (612)..(612): a, c, t, g, unknown or other
  misc_feature (612)..(612): n is a, c, g, or t
tcagtcgtcgctcgcacgaccggtgctcgatttagactcatctacagggaaagggggtgggtccaggaggcagaactcgtgggtgtctcaccatggcctggactcctctacttcctcccctctcnctctctgcacgaggctctgacgcctctagtgagctacgacacacgcccacccgttggtacgtcgtacgtccggaccccgaaggacgacggaccggaccgaaggactccaccgtgctccgagcagtaggngacagaaactaaagtattagtacgttacttagtaccggaaacaacgaaaggacgtaccgacggaccctacggtaccgtgtagggttacaataaagtactaaaagtaaacgactacggtacgaggtacccggactacggaacggtataccgtaccgtagaacggtctaactttcgtacgtacgtacccgacgtactaacgggaccggaagtaaccacgggttactagttaaccgtaggtacgtaaacgttgaacggtaagtacgggttaaacncccggaaggaacggaaggaccggaacgggacgtaacgtaaccgtttacgtaacgttaacgtaacggaaacctaaggaaccggtaanaacggttaaacggtaggtaacttaacgggttcgtaaggggttcgggtacggtacggacgggaacgttacgaacgtcgacgttacggacgtacggtcccgaacggacccgtacgtccggtacccgcggttaccgg

SEQ ID NO: 201651 - DNA, 796 bp, Homo sapiens
  misc_feature: GYAE6OF01DURR5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctctatgagctgacacagccacctggtgtcagtcgtcccaggacagacgccaggactccactgctctgcagatgactgaccgaaagaatctgtacttattaggtaaccaacgagaacgtccgaaggacctacggtccccttaggttacgttacggtagtaactacttaacgttaaaggacctaaacgttacggaacgtaaccggtcccccttaacgaacggtaaacgtccgtaccccgtttaggaacgtccggttaactttccgttacggtcgggtaccttaccgacgtaccgtacggaacgggtacctacggtacgtaacggttaccctaaacggggtttaccaacgttacgttaaccgtaacgggttaccgtaaaaccggtttccggaacgggttaccgtaaacgggaaccgggtaaaccggtacggtacgtaaccggttaacgtttaacggtttaacgtaaccggtaaccgtaaacgtaacggtaacgtaacgttaagggtaccggttaacggttacttaaccggtaggttggggttaccgtacgggaaccggtacgggaaccgtaacggtacccgttacgggtaccccgtaccgtacggtacccgacgtaacccggaaggtcccgtacccggttccccgtaaccggg

SEQ ID NO: 201652 - DNA, 777 bp, Homo sapiens
  misc_feature: GYAE6OF01B4Y1I.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtgggtccaggaggcagaactctgggtgtctcaccatggcctggatccctctacttctccccctcttcactctctgcacaggctctgaggcctcctatgagctgacacacgcccaccctcggtgtcagtcgtccccaggacaggaccggccaggactcacctgctctgacagatcggactgaaccaaaagaatntgtacttaagttacggtaaccaaacgaacgtaacgaccgacgggaccgtaaccgggtacccccgttggttacggttaacggtacggtaaattaacgttaaaagtaaaacggtaacctaacgtacggaacggtaaccggtaccccgttaacgaacggaacgtaccctcccgtaggtacgtaccggttacttccgtaccgtcggtcctaccgacgtccgtacggaacgggacacgtcgtacgtacgtagtacgtactatacgtagtacgaacggtaccgaggtacgaacgggacggacgacggtcgtacgtaacgttacttacgttacgtaaacctaacgtaacgtaacgtaacggtaaggtaacggtaacggtttaaccgtaggtttacgggttcggggttaacgggtaccggggtacggtaaacccgggtaacggtacgtacccggtaccggttaacccgggtaccgtaccggaaccgtacccggtaaccggtaacggttccccgtaccccgtccccgggttacccg

SEQ ID NO: 201653 - DNA, 990 bp, Homo sapiens
  misc_feature: GYAE6OF01D517K.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacgaggctctggacgtcctctatgacgctacgacacacgacccgtccggtcggttctaccgtacgtccgtacccgaggaccgacggaccggaccgtaggtacttaccgaccgtcgtcttccgacgacgaggtacggtcgtaacgtacgaaacgtaaaagtaacgttagtcgttaacgtttacgttaaccgaaaccgaacgacgaacggtaccggaccggtaccgtaccggttaccgttaggtttacgtaggttaagtaacgtttaataaaacgtaacgtaacctaagggtacgtaaccgggtaccggtacccaggtacgaacgtaccgttcgtaacggacgttaccgttacgttccgttacgtcccgtcctacgtccgtaacgacggtacggaactacgggtaccgttagttaaccggtacgttaccgtaacgtaaccggtacgttaacgggtaaccgttaacccggtaggaacgggaacgggtaacgggaacgggtacgtaacgggttaccttaacgttacccgtttaaaggttaccggttaaacccggtaaacgtaaacggttaaacgggtaacggtaaaccggtttaaagggtaaaccccggttaacgggtttacgttttaaacgggttacgggggttttacgggggtaacccggggtaaccgggggggttaaacccgggtaaaacgggttacccgttaaaacccggggggtttcccttaaaacccgggggttaccccgggttaacggtttaaacccccggggtaccgggttaaaccccggggttaacccccgggttacccgggacccccccgggtttttaaacccccccgggcccgggtttttaacccccggg

SEQ ID NO: 201654 - DNA, 667 bp, Homo sapiens
  misc_feature: GYAE6OF01EQKI5.21.46.E02.1.454.CMB.1.raw
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
tcagtcgtcgctcgcacgaccggtgctcgatttagactcatctacagggaagggggtgggtccaggaggcagaactctgggtgtactcaccatggcctggatcctctacttctcccctcctcactctctgcacacggctctgacggcctcctatgagtctagacactagccacccgtcggtagtcagtcgtcccaggacacgcggccaggactcacgtgctctgcagatggactgacaagtaatntntcttagtcgtacaacgagaacgcaggccaggtccctgtagtagtacgatagtaataacgacacgtagaacgcggtacctgagtacgactccgagacgcgtactctacgtcgcgtccagacgtacggacggtacgacgtacgacgttacgtaacgttacggacctaacgtacgtaagtacgacgtacgacggtacgacgggaacggacggtacggtattacgtaacgttacttacggtaactaacgtaacgtaacgtaacgtaacggtaggtaacggttacgttacgttacggttacgggttacgggttacgggtacgggtacgggaaccgttacgggtacgttaccggacccggttacccggtacgtaaccgaccggtaaccgtaccggtacccgacccgttcccggacccgtttacccg

SEQ ID NO: 201655 - DNA, 770 bp, Homo sapiens
  misc_feature: GYAE6OF01D2P1R.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgacggcctctatgagctagacacacgccctacccgtggtgtccaggtccgtacccgaggaccgacggccggcctaggactccacgtgccttcgtgacgagtagtacggacctacgaaccaaaaagtaacgttacgtcgttacgtttacgttacggtaaaccaacgaacgaacgccgacggaccgtacggtccccgttggttacggttaggtagtaagttaacgttaaagaaacgtaacctacgtaggtaacggacccgtaccgtacgaacggtaacgtaaccgtacccgtaaggtacgtacggttaaccgttccgttaccggtacggtcccttaacgggaccgttacggtaccggtaacgggaccgtaaccgtacggtaccgttaccggtaacgttacgtaccttagtacgtaagtaacggtacgtaccggtacggaacggtacgggacgggtacggtacgtacgtagtaaccgttaacttacggtaactaaacgtaacggttaacgtacgtaaacgggtacgtaacggtacgtagttacggtaggtggtcggtacggacgggtacgacgtcgtcggtacgacgttacggacgtccgaacgtaccgacggtcctcccggtcccggtacg

SEQ ID NO: 201656 - DNA, 772 bp, Homo sapiens
  misc_feature: GYAE6OF01A6HWC.21.46.E02.1.454.CMB.1.raw
  modified_base (141)..(141): a, c, t, g, unknown or other
  misc_feature (141)..(141): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (455)..(455): a, c, t, g, unknown or other
  misc_feature (455)..(455): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctcngagcctcctatgagctgacacacgccctacccgtcggtcgttcagtcgtccccaggacagaccggccaggactccacctgcttcngacagngtggaacctggaaccaaagtaatacttgtactttagttacggtaaaccaagaggaaccgtcccaacggtacccacggtcccccgtagttgttaaccgtgtaattaacgttaataaacgtaccacggtgacggtaccggtacccgtacgaaggaccgtaccgttcccgtaggacgtaccgttattccgttccgtcggtcctccgtacgtccgagaacggtaccncgtacgtcggtaccctaggtttaccgaacgtttactaccgtaggtacggtaacccggtacggtaacggggacgtaacgggtaacggggtaacccgtagggttccgttaaccgttaacgtttaacctttaacggttaacgtaaccgttaaaacggacgtttaaaggtaccggtaagggtaaccgttacgggtacctttaggtacgggtttttcgggtccggttacgggggaccggttaacgggaaacccgtgacccggttacggtaccggtacgcgttaccgaccgacggaacccgtccgtaccccggtccccgtacg

SEQ ID NO: 201657 - DNA, 581 bp, Homo sapiens
  misc_feature: GYAE6OF01CVBDI.21.46.E02.1.454.CMB.1.raw
  modified_base (395)..(395): a, c, t, g, unknown or other
  misc_feature (395)..(395): n is a, c, g, or t
  modified_base (566)..(566): a, c, t, g, unknown or other
  misc_feature (566)..(566): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgacaaaagatatgacttattggtaaccaacagaacgccaggccacggcccctgtcgttagtgatataagtaaagacactagagacgcctgagagactaccgtgacgaccgtattctcgtcggtcctccgaagtctacgagggacagacgagtcacgttgaacttanctaagtagtaacgtcgaggacaacgggtaggacgaggtctgtaacttattacgtagtaaccaaacgtaagtaacgaacgtacggtagtacggttactagtagttggggtacgttcgggacgggaggtacaacggtcgtacgaccgtcgtacggacacgacccgaggtcccnccgtccccgttacgg

SEQ ID NO: 201658 - DNA, 865 bp, Homo sapiens
  misc_feature: GYAE6OF01BG80E.21.46.E02.1.454.CMB.1.raw
  modified_base (654)..(654): a, c, t, g, unknown or other
  misc_feature (654)..(654): n is a, c, g, or t
tcagtcgtcgctcgcacgaccggtgctcgatttagactcatctacagggaaagggggtgggtccaggaggcagaactcgtgggtgtctcaccatggcctggatccctctacttcctcccctctctactctcgtgcacgaggtctcgtaggacggtcccttcttagtgacgtctacgaccaccgacgaccctaccggttcggtcgtcgacggttccgtacccgaaggaccgacggaccggaccgtaacggtactaccgtaccgttcgtccgttacgtcgaccgtaagtacggtaccggtaccgtaacgtaaaaccgtaaaagttaaacgttcgttacgtttaacgtttaacggttaccggaaaacctaacggaacggaccgaccggtaaccggcccggtaaccgtttccgttaggtttaccggttagtaacgttaacgttaaacggaaagtaaccggtacgtacggtagggacccgtaccgtccgaacggaacggttaactccccggttaacggtcggtaacttccggtttacccttcggtaccggttacccggtaccgtacgtacccggtcggtaaaccgggacgtacggtaacccggtaagttaccgttacgtaccggtacgtacgtacgtacggtaaggtacgtacgtacgnggtaaccggagggtaccgacgttagacgttagtaaccttagtaccctaaggaacgtacgtacggtaagtcggttaagcggtttacctacggttaggtcggtttacgggagggttacgggacggtaaccggtcggtcgtacccgggttaacggtcccgtaaacggttccggaacgtaccggtcggtaccccgtcccggtccgttcgtacccg

SEQ ID NO: 201659 - DNA, 777 bp, Homo sapiens
  misc_feature: GYAE6OF01C1L0R.21.46.E02.1.454.CMB.1.raw
  modified_base (150)..(150): a, c, t, g, unknown or other
  misc_feature (150)..(150): n is a, c, g, or t
  modified_base (516)..(516): a, c, t, g, unknown or other
  misc_feature (516)..(516): n is a, c, g, or t
  modified_base (550)..(550): a, c, t, g, unknown or other
  misc_feature (550)..(550): n is a, c, g, or t
  modified_base (705)..(705): a, c, t, g, unknown or other
  misc_feature (705)..(705): n is a, c, g, or t
  modified_base (723)..(723): a, c, t, g, unknown or other
  misc_feature (723)..(723): n is a, c, g, or t
  modified_base (773)..(773): a, c, t, g, unknown or other
  misc_feature (773)..(773): n is a, c, g, or t
tcagtcgtcgctcgcacgaccggtgctcgatttagactcatctacaggggaaagggggtgggtccaggaggcaggaactcgtgggtgtctcaaccagtcggcctggacttccctctacttcctcccctctcactctctgcacaggctcgngacggtcctactatgagctacgacacacgccctaccgtcggtgtacgtcgtccgtcccgaaggtacgacggacggaccgacggtacctaccaccgttcgcttacggtcgacggtaagtcgtaccgggactaccgaaacgaaaagaaactttgtcggtaacgttttacgtacgaaaccgacgtaacggaacgtaccggacgaccgttaccggtaccgtggttaggtacgtataagtaataacgaactacgaacggtagaacggtccgacctagtaacggtacttaccgtaccggttacggacgttacgttcgttacggtaccgttacggttcccgaaacgtcggacccgtaaggggacggtaacccnggtaccgtttaacggtaacgtcgttacgttaacncggttaacgagttaacgggaccgtaacggaacgggtaccggtaggaacgggtaccgaggtttacccggtaatacgtaacgtacgttaacgaaccgttaaagacggtaagtagggttaacacgggttactggttaacgggtagttcgggtacgggngggtaacggacgtaacgngggttacgacggttaccgaggtacacgtacggacttcggcctccggtacncccg

SEQ ID NO: 201660 - DNA, 788 bp, Homo sapiens
  misc_feature: GYAE6OF01DK538.21.46.E02.1.454.CMB.1.raw
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagtcgtcgctcgcacgaccggtgctcgatttagactcatctacagggaaagggggtgggtccaggaggcagaactctgggtgtctcaccatggcctggactcctctacttcctcccctcctcactctctcgcacgaggctctgacggtcctacctatgacgctagaccacacgccctaccgtcgtcgtcgtacgtccgacccgaggaccacggaccgaccgtaggactaccgaccgtcgtccgtccgtagacgtaagtacggtacggtaccgaacggaaaaccgtaaaaagtaaactttacgttacgttacgttttaacgttaccggaaacgaaaaccgaaggaaccggaaccggccggacccggtaaccggtccttagggttagttaagtacgtaataagtaaacgtaacgaccttagagaccggaccgaccgtaanacggtactacgtaccgngtacttacgtactttcgcgtacgtctcgactacggtacggacggtaacgcggtacctacgttacggttacgttaacgtaacgtacgttaactaacgggtacgtaccggaggaaccggtaaggaacgggtacggaccgtaaggtacggttaacttacgtttaaccacggttacaaacggataacggtaagaacggtaaggtaactactcgttacgggttacggtcggggtaagtccgggaaccgtagggtaaacctccggtacggttaccggacgttccgaacgggtcccgtaccggtaacgtaccccgtcggttaccccgcggttaacccg

SEQ ID NO: 201661 - DNA, 733 bp, Homo sapiens
  misc_feature: GYAE6OF01A8X7L.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtccagtcgtccccaggacacgacggccaggactcacctgctctgcagatggactgaaccaaaagaatatgtactttagttacggtaaccaaacgaagaacgtcccgacggacccgaccggtcccccgttggtacgttaaggtcgtaattaaagtaaagttaaaacggacctaacgtaggaacggtaccgggtcccctaacgaacggtaacgaaccttccccgtagaacggtacgttacgtttaccttcggtacgggtaccctaccgtacgtccgtacggaacgggaccgaacgccgtaacgtaccgtacggttacgtaactactcggtaagttacggaactacccgaggacgtaggaacggggacgtaggtctacgtacttaacgtttacgtacgtaaccaaccgagtaacgtacgtaagtacggtaaggttactacgtacgggtttgggtacggttaccgggacgggtaaccggaccgtaacggtcgtacccggtaccggttacggtcggaaccctaacgggccctacggcccgtcccgtcccccggttacg

SEQ ID NO: 201662 - DNA, 781 bp, Homo sapiens
  misc_feature: GYAE6OF01CBTA6.21.46.E02.1.454.CMB.1.raw
  modified_base (155)..(155): a, c, t, g, unknown or other
  misc_feature (155)..(155): n is a, c, g, or t
  modified_base (177)..(177): a, c, t, g, unknown or other
  misc_feature (177)..(177): n is a, c, g, or t
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcacctctctgcacaggctctgagcctctatganctgacacagcccaccgtcggtntcgagtccgtaccccgaggaccaggaccggccgtaaggctccgacctgccttcgtcgcgtaagngttacggacgtcgaaacctaaaaggtaaaatgtacgttatttacgttacggtaaaccaacgtaacggaacgaccgaccggaccgtacggccccttaggtcgtttacgagtaaataacgttaaataaacggtaccgaaggtcgtaaccgggacgtacccgtagaaccggaataccgttacccgtaggaagttccgtacgtttccgtcgtcggtccccgtaacgtcggtaccttaacggaacgggccgtacgactacgggtccttaggtactacgttacgtaacggtgtaacggtaacgtccgtacggacgaggtaacgggacgtacggtacgtacgttaacgttaactaccgagttaacccgaataacgtaagtacggtaagtaacgggtaacgttacgtacggttaggttcgggttacggtacccggggagggtaaccgtaccggtacccgggttacgtaacccgggttaccggtaccgtaaggttccgtaacggaccccggtaagggtcccccgtacccggtccccggtttaaccccgg

SEQ ID NO: 201663 - DNA, 864 bp, Homo sapiens
  misc_feature: GYAE6OF01EQO99.21.46.E02.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagactcatctacagggaaaggggtgggtccaggaggcagaactctgggtgtctcaccatggcctggatccctctacttcctcccctcctcactctctgcanagctctgagcctctatgagctagacacacgccctacccgtcggtcgtacacggttccgtaccccgaaggaaccgaggaacccggaccgaaggtactccctaaccgtcgtcctgtacggacgtaagtacgtcggtaacctacgaaacctaaaaaggtaattacgtgttaacctttaagttaaccggtaaaccctaaagaacggtaaccgacccgtaaccggtacccgtaccgggtcccccgttaggtttagttaaccggttataaactttaaacgttaaaactaaaacggtaccgaacgttaacggaaacggaccggtacccgtaacgtaacggagttacccgtaccgtacggaataccgttacttcgtccgtacgtaccctacgctacggacgtaacggactacggacgtagtccgtacgttagtaactcgtaacggtcggtaacgaaaccggtcgaacggaggtaacggaaccgggtaacgtacggtccgttaaacgttacgttaaattccggaagttaaacccaaacgtaagggttaacccgaaggttaaggttacgggtaaacggttcttaaacggggttgggtttgggaacccggggttaccggaaacggggttaaccgaaacccgggttggtacccggtacgtttaaccggccccgtttaaggggaacccctaacccgggtaacccgttacccggaccgttccccccgggtacccttacccgggg

SEQ ID NO: 201664 - DNA, 812 bp, Homo sapiens
  misc_feature: GYAE6OF01DE2NB.21.46.E02.1.454.CMB.1.raw
tcagtcgtcgctcgcacgaccggtgctcgatttagactcatctacagggaaagggggtgggtccaggaggcagaactctgggtgtctcaccatggcctggataccctctacttctcccctcctcactctctgcacaggctactgagccgtcctagtcgagctagaccacaggccctaacccgtcgggtcgtcacgtcgtaccccgaggaccaggacggccaggactccacctgctctgcagtactggactgaaccaaagtaaactgtggtacttacgttcggtaaaccaacgtagaacgaccgacggaccgacggtccccgtggtacgttacgtagtagttaactaacgtaacacgacgtacgaggtaccgcccgtacacggtaagacctaccgtacggctaacgtcgttacctacgtcgccgtacctaggtaccgtacgaacggggacctacggtccgtacgtacgtacgttacgtacgttaactacgtaagggtaaccgacggtaccggaacggtaacgtaacgggaccgggtaacgggtaccgggtacgtaacggtaaccgttactttaaccgtaacggtaccgtaaaacgtaggttaaacgtaacgggttaaggttaacggtaacgggttaacgtttacggttacgggtttaggggtttacccgggtacgggggtaccggggttaacgggaacccgtaaacggtacccgggttaacccggtaaaccggttacccgggttacccgttaacgggaacccgttaaccccgggacggttaccccgggtaccccgtccccggttaacccgggg

SEQ ID NO: 201665 - DNA, 797 bp, Homo sapiens
  misc_feature: GYAE6OF01A2CFO.21.46.E02.1.454.CMB.1.raw
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
tcagtcgtcgctcgcacgaccggtgctcgatttagactcatctacagggaaagggggtgggtccaggaggcagaactctgggtgtctcaccagtggcctggatccctctacttcctccccctcctcactctctgcacaggctctgacggcctcctatgacgctgacacacgcccacccgtggtgtacagtcgtacccgaggacagaccgcgagactcaccgtgctcncgnagtatggacctagaaccaaagtaattntgtacttagtacgtaaccaacgagacgccgacggaccgtacgccgtgtcggttagtagtaactaagtaataaacgacgtacgtagacggaccgtcccgtaagaggtaacgactacccgtagacggtacgtacgttcctacgtcgtaccgtaccgacgtacgtacgaagggtaccacggtaacgtacgtacccggttaagtttaaccgtacgttacgtaacgtaacgggttaacggaacccgttaaccgggaaggtaaccggaaggggttaaccggaaacgggtacggtaaccttaacgttaaccgttaaacgttttactaacggttaaaaccgtaacgtaaaccgtaacggtaacggttaacggtagggttaaaccgtttctttaacgggttcgggtttacgggttaccggggtaccgggtaacgggaacccggttaaacggtaacccggtccgggttaacggacccggttaccgggtacgggacccgttaacccgtacccgggttacccgtcccggtcccgttaccccgggttaacccg

SEQ ID NO: 201666 - DNA, 747 bp, Homo sapiens
  misc_feature: GYAE6OF01B133N.21.46.E02.1.454.CMB.1.raw
  modified_base (410)..(410): a, c, t, g, unknown or other
  misc_feature (410)..(410): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacagctctgaggcctcctatgagctagacacacgccacccgtggtgtcagtcgcccagacaggacggcaggactacacctgctctgacagataggacgtacgaaccaaaagaatagtacgtactttagttacggaaccaagaacggaacgaccgacgggaccgaacggtccccttggtagttacggtagtaactaagttaaataacgactacggtagaacggaccggtccctaggagtacgacgttcccgaggacgtagtacttcgtcggtacgtcncgtacgtcgtacggacgggtaacacggtagtaaccggttccgtaagtttacgtaaccgttagtaccggaagttacgaacgtcccggaagtacggaaggacgggacgtacgggtactacgaactttaccgtaagttagtaaacctaaggtacggtaacgtaaccgtaaggttacggtaacgtaccggttatttaggggtcgggtttacgggttaaccgggaggggtaaacccgggtaccgtaacgggtcccggttacggtaacccggttaccggtaaccgggtacgacccggtaaccggttaacccgggtcccgaccccgggttcccccgttaccggg

SEQ ID NO: 201667 - DNA, 795 bp, Homo sapiens
  misc_feature: GYAE6OF01AUZTC.21.46.E02.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgccaccctcggtgtcagtcgtcccaggacagacggccaggactcacctgctcngcagagtggactcgaccgaaaagtaatatggtactttagttacggtaaccaacgacgaacgccgacggccgaaccggtccccgttaggtacggtttaggtaggtaaacttaagttaaaacgtaaaaggtaaccgtaacggttacggaacgggtaacccggtccccttacgaacggtaacgtacccgttccccgtaggacgtcgtaactttccgtacgtcggtaccttccgacgtacccgtcggaacgggtacgacgtcgtacgttacgtaccggttacgtacgttactacggtagtacggtaaccgttacggaacgggtacgtacgggaacggtacgggtacgtacgtacgtaacgtttacttaacgtccgtaaactaacgaacgtaacggaacgttaacgggtaaggtaacgttacgttaacgttaggggttacggggtttacgggtacgggtaaaccggggtacggtaacccggtaacggccgggttaccgggtacccggttaccggttaaccgggtccgtaacccgggtcccgggaaaccggtccccggtaccccggtccccggttaacccggg

SEQ ID NO: 201668 - DNA, 810 bp, Homo sapiens
  misc_feature: GYAE6OF01BPF28.21.46.E02.1.454.CMB.1.raw
  modified_base (182)..(182): a, c, t, g, unknown or other
  misc_feature (182)..(182): n is a, c, g, or t
  modified_base (492)..(492): a, c, t, g, unknown or other
  misc_feature (492)..(492): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacacgcccacccgtcggtntcagtcgtccccaggacacgaccggcaggactccaccgtgctcgtcgacagagtggactgaaccaaaagaatatgtacttagttacggaaccaacagaacgccgacggaccaccggtccccgtgttcgtttaggtacgtaattaacgtaaagtaaaacggaccgtaacgtagggtaacgaccgggtaccctacgaaggaacgtaccgttaccccgtaggtaccggtaccgttacgtttccgtcggtacggtcctaccgacgtcctacgggacggacgacgtcgtaacggtccgtacgttactaacgttanacgtagtagaaccgtaccggagtaacggtaagggacggtaacggaggtaccgtaacgttaacttaacgttacgttaaccgtaaacgaaacggtaacggtaacgtaacggtaacggtaacggttaaccggttacttaaccgggttgggttttaacggggttacgggtttaaccgggggaggggtaaacccgggtaaacgtaacggttaccgggtaacccggttaacccggggtaaccggttaccggttaccccggaaacccgggtacccgtaaacccggggttcccttacccccccgggtccccggtttaaaccccggg

SEQ ID NO: 201669 - DNA, 718 bp, Homo sapiens
  misc_feature: GYAE6OF01A660M.21.46.E02.1.454.CMB.1.raw
  modified_base (219)..(219): a, c, t, g, unknown or other
  misc_feature (219)..(219): n is a, c, g, or t
  modified_base (224)..(224): a, c, t, g, unknown or other
  misc_feature (224)..(224): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgccaccctcggtgtcagtcgtcccgaggacagaccgccaggactcactgctcgngcagntgactacgaccaaagaatatgtactttagttacggtaaccaaacgaggtaaacgccgacggacccgaccggtacccccgttggttgttacgtagtaattaataagtaaagacaacgtggacggacggtcccagagtacgaccttaccgtaggacgacggtattcgtacgtacgtccgtaccgtactaccgtaccggtaacgggacgtacgacgtacgttaccgtacgttaacgtactttacacgtacggtaacgtaaccgcggtaacgggacgtagggaacgggacgggtaggtccgtaggttaaccttaacgttaacttacggtaaacaaacgtagaacgtacgaaggtacggtagttaacgtaggtacggttacgggttcggtaccgggtccgggtaaaccgggaccgtacgtacggtacccggttcccgtacggtacgtaccgggtaccgtaacccggaccgtacccgtcccggttaccccgttacccggg

SEQ ID NO: 201670 - DNA, 778 bp, Homo sapiens
  misc_feature: GYAE6OF01DT7JF.21.46.E02.1.454.CMB.1.raw
  modified_base (132)..(132): a, c, t, g, unknown or other
  misc_feature (132)..(132): n is a, c, g, or t
  modified_base (137)..(137): a, c, t, g, unknown or other
  misc_feature (137)..(137): n is a, c, g, or t
tcagtcgtcgctcgcacgaccggtgctcgatttagactcatctacagggaaagggggtgggtccaggaggcagaactcgtgggtgtctcaccagtggcctggactcctctacttcctcccctctcactctcngcagngctctgcgcctctatgacgctagacacgacgccctccgtggtcgtcgacgtccgacccgaggaaccgacggaccggaccgaggtacctccgtaccgtcgtccgttcgacgacgagtagtaccggaacctaacggaaaaccgtaaaagtaacgttgttacgttacgtttaacgttaaccggaaaccaacgaacgggaaccgaccggtaccggacccgtaccggttcccgttggttacggtaaggtattaataacgtaacgtaacgacctagacggacgtccgactagacgactaccgtcgtagacggtactacgttcgcgtacgcgttacacgaccgtacggacggtaacacgtacggttagtacggttacgaacgttacgtgtaacggacggttacgaccggttaacggaggtaacggacgggtaacggtaacggtcgtacgtaacgtttactaacgtacgtttaagaacgtaactaaggtaacgaagttaacgggtacgttacggtacttagggttacgggttacggtacggtacgggtaccgggaaggtacccggtacggtacccgttacggtaacccgttcggtaacccgacgggtacctaccgggtacccggtccgttcccgggtcccttacccggg

SEQ ID NO: 201671 - DNA, 837 bp, Homo sapiens
  misc_feature: GYAE6OF01C4QV5.21.46.E02.1.454.CMB.1.raw
  modified_base (634)..(634): a, c, t, g, unknown or other
  misc_feature (634)..(634): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctcgtgacggcctcctatgagctgacacacgcccacccgttcggtgtcctaggtccgtaccccgaggacgacggaccggaccgaggtactccaccgtcgtccttcgtagacgaagtacgtcggtacctaacggaaccgtaaaaaggtaaattacgttacggttactttaacggttaacggtaaaccaaacgaacggaaccgccgacggaccgaccggtccccgttaggttacggttacgtaggtaattaagttaacgtaaaacgaccgtaacggtacggaacggtacccggtacccgtacgtaaggtaaccgtaaccgttaccgtagggaccggtaccgttaacgttttcccgtcggttccgggacccttaccggacgtacgtcgggaaggaccgtagaccgtacggtacctacggtttacgacttacgtacgacggtaacgacggtacccgaagggacgacgggaggacggaggtcacgttaactagttacgtanaacgtaacgtagtaacgagttaacggtaaggtaccgttacgtacgttgggttacgggtaccgggcggggaaaccgggtacggtaaaccggggacggttacccgtaaccccgggttccgggttacccggggttaacggacccgggtaaccccgggtaccggtacccgggtaccccgggttccccggtaccccgggttacccggg

SEQ ID NO: 201672 - DNA, 741 bp, Homo sapiens
  misc_feature: GYAE6OF01BM5BU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacacgcccacccgtcggtgtcacgtcgtccccaggaccaggaccggccaggactccacctgcctcgtgactagagtcggactacgaaccaaaagtaaattactgtacttagttacggtaaccaaacgaggaaccgcgacggacccgacggtcccccttggttacggttagtaggtaactaattaaacgttaaaacgacctaacggttaggaacggtaccgggtacccccttagaaggaacgtacccgtacccggtaggtaacggtaccgttaagtttccgtaccggttacgggccctacggagtacccgtacggtaaccgggaacgtacgcgtaacggtacccgttacgttacgaacttacgtacgtaggtacgtacgtacgaacggacgaggaggacggtacgcggtattaacgttattacgtaacgtaacaagtacgtaagacgtaaggtacggtagttaacctacggtagggtttagggtccgggtacgggacgggaacggactaaggtccgtaacggtcccgtacggttacgacccgtacggacccgacggtaccctcccggtccccggttccg

SEQ ID NO: 201673 - DNA, 710 bp, Homo sapiens
  misc_feature: GYAE6OF01BTOQG.21.46.E02.1.454.CMB.1.raw
  modified_base (239)..(239): a, c, t, g, unknown or other
  misc_feature (239)..(239): n is a, c, g, or t
  modified_base (501)..(501): a, c, t, g, unknown or other
  misc_feature (501)..(501): n is a, c, g, or t
  modified_base (562)..(562): a, c, t, g, unknown or other
  misc_feature (562)..(562): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacgaggctctgaggccctcctatgagctagacacacgcccacccgtcggtgtccaggtcgtccccgaaggacaggaccggcaaggactcacctgctcgtgactagngtcgactgaaccaaaagaatagtagtactttagtacgtaaccaaacgagtaacgaccgagggtacccacgggtcccttggttacgttaaggtagtaactaataaagtaaaaccgtacaagtacggaacgaccggtaccgtacgaagacggtacctacgtaggtaacgtccgtaattccgtacgcggtacaccgcggtactaccgaagggtaccacgacgttaacgtcgtacgtaacgtactagtacgagtaggtaacgacgnggaacgaaggtcgggaacgcggtagtacgtaacgttaagtacttaagtaaaccaaacggtntaaacgtacgaacggtaagtaccgtagttaggtaggttacgggtaggtaccggacgggtacgtaaccggacgtaccggacggtaccgtaccgggtaacggtacccgacgggtaccctaaacgggtcctccccggtacccggttaccgg

SEQ ID NO: 201674 - DNA, 810 bp, Homo sapiens
  misc_feature: GYAE6OF01ENZFH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacacgccacccgtggtgtcagtcgtcccaggacagacgcaggatcactgctctgacagtagtacggactacgaaccaaaagaaatagtcgtacgtttaagttacggtaaaccaaagtaacggaacgaccgaacgggtcccgaacggtcccccgttaggtaggtttaagtacgtaactaaagttaaacgtaaaacggtaaccacggttaggaacggtaccggtaccctaacgaaggaacgtaccttaccccggtaggtaacggtacgtaactttccgtcgtacggtaccttacccgaacggtacgtaccggaacggggtaaccacgtaccggtaacgtaccggttaacggttacgtaacctaacgttacgtaaaggtacggtaaaccggtacccggtaaagggaccaaacggggtaacggaaccggtacggtacgtacgtaaaccgttaacgttaacgtacgaaccgtaaagtcgtaacggaaccgtaggttaaccggagttaccgtagttacgggttgggttacgggttaaccgggaccgggtaaacgggtaccggaaacggtccgttaaccggtccggtaaccggtaaccggtaaccgacccgggttaaccgaaccgggtccccgttcccgccccggttacccggg

SEQ ID NO: 201675 - DNA, 671 bp, Homo sapiens
  misc_feature: GYAE6OF01C9YE7.21.46.E02.1.454.CMB.1.raw
  modified_base (223)..(223): a, c, t, g, unknown or other
  misc_feature (223)..(223): n is a, c, g, or t
  modified_base (302)..(302): a, c, t, g, unknown or other
  misc_feature (302)..(302): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacagctctgaggcctcctatgagctgacacacgcccacccgtcggtgtcagtcgtcccaggacagacggcaggactcacctgctctgcagngtggactcgaccaaaagaatatgactttaagtcggtaaccaacagaagcgaggccacgccctgtgtagtgtaatataanaagacacgtagagtcggcctagagagactaccgagacgacgtacttctcgtggtcctacgacgtccgtacggaaggaccacggtaccgtacgttacgtacggttacgtaacttacgtcgtaagtacggtaaacgtaccgtaagggaaccgaagggaacgggaacggtacgggtaccgttacgtaacgtttaacgtttacttaacggaactaaaacggtaaggtttaacgaacgtaagtacgggttaacgttacgttagttacggttagggttcgggttacgggacggggacggtaacgaacggtcgtacggtacccgttacggtacgaccggtaacgacccgaacggtccgtcccgtccccgttaccgg

SEQ ID NO: 201676 - DNA, 768 bp, Homo sapiens
  misc_feature: GYAE6OF01CRBQG.21.46.E02.1.454.CMB.1.raw
  modified_base (227)..(227): a, c, t, g, unknown or other
  misc_feature (227)..(227): n is a, c, g, or t
  modified_base (239)..(239): a, c, t, g, unknown or other
  misc_feature (239)..(239): n is a, c, g, or t
  modified_base (393)..(393): a, c, t, g, unknown or other
  misc_feature (393)..(393): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctctatgagctagacacacgcccacccgtggtcgtcgacgtccgtaccccgaggacacggaccggccgaggactcaccngtctctagcagngtacggacacaacgaaaagtaatgtcgtattacggttacgaaaccaagagaacgccgacggaccgtacggtcccttaggttaggttacgataacgttaataaagtaaaccgacacgttaggacggacgaccctacgagtactaccgtccgtagnggtaccttattccgcgttacggcctacgacgacgtacggaacgtacgacgaggttactaccggtacgtttacggtaaccttacgggtaaccgtaggggttaacgtaacccggacggtaacgaacgggtaaacggggacgaacgggttacgtggtaaacgtccgtttaaattcggttaacgaaacaacgttaacggtagtaaacggtaagggttacgtaaacggtctttaacgggtgggttacgggttaaccggtaccggggaacggggttaaccaccggtaaccgtttacgggacccgttttaaccggggacggtacgtacccgggaacccgacccggggttagttaccccgtccccgggtaaccccgtttacgg

SEQ ID NO: 201677 - DNA, 700 bp, Homo sapiens
  misc_feature: GYAE6OF01CQ071.21.46.E02.1.454.CMB.1.raw
tcagtcgtcgctcgcacgaccggtgctcgatttagactcatctacagggaaagggggtggtccaggaggcagaactctgggtgtctcaccatggcctggatccctctacttctccccctcctcactctctgcacaggctcctgacgcctcctatgagctgacacgacgccctacccgtggtgtcagttcgtccccgaaggacacggaccggccaggactccaccgtgacctcgtgcgagagtacggtactcgaaccgaaaagtaatagttcgttactttaacgtacggtaaccaaagtaacgaacgccgacggtaccgaccggtcccgttagttacggttagtagtaattaactaaataacgactaacggtcgaacggccgacctacgaagtaccgtacgccgtagcgacgttacttccgttacgtcggtaccctaccgtagtccgacggaacggacgcgtaccgtaacggttccgtacggttacgtacttacgtacgtaggtacgaacgtacggacggacgtaaagggacggacggacggtactaacgtacgttaactcggaactaaacaggttaacagtaacgaggtcgtaatcgtaccgtagggttcggtaccggtcggaacgggtacgaacgtacggtccgtaaccgtccggttacgtaacggccgtaacgcccgaggtcctcccgacccgttacg

SEQ ID NO: 201678 - DNA, 764 bp, Homo sapiens
  misc_feature: GYAE6OF01A71IP.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggacggccaggactcacctgctctgcagagtggactgaccaaagaaatntgcttaattggtaaccaacagaagccaggccacggcccctgtgtagtgatatataaagacacgtagagacgggccctagaggacgtacttccccgtaggacgcggtactttaccgtcgtggggacccttcccgaacggtccttacggaacggggaaccacgggtacccaacgggtttaccctaacgggttttacggtaaccgttaacgttcccgtaaaggttacggttaaaaccggtacccggtaagggacccgaaagggtaacggggaaccggtacggtcgtacgtacgtttaacgttacgttacgtaaacgtaaactagggtaacgtaacggtaaggtaacgggttaaccgttacggttaaccgtaggtttcgggggttaacggtttcgggggaccggggtaaagggtaccccgaaacggtccggttaaccgggtaccccgtttaccgggtaacggtaaccggtaccgggaaccccgtaaagggttcccgtaaccccgggtcccccggttacccggg

SEQ ID NO: 201679 - DNA, 647 bp, Homo sapiens
  misc_feature: GYAE6OF01CYVG0.21.46.E02.1.454.CMB.1.raw
  modified_base (135)..(135): a, c, t, g, unknown or other
  misc_feature (135)..(135): n is a, c, g, or t
  modified_base (370)..(370): a, c, t, g, unknown or other
  misc_feature (370)..(370): n is a, c, g, or t
  modified_base (545)..(545): a, c, t, g, unknown or other
  misc_feature (545)..(545): n is a, c, g, or t
  modified_base (553)..(553): a, c, t, g, unknown or other
  misc_feature (553)..(553): n is a, c, g, or t
  modified_base (635)..(635): a, c, t, g, unknown or other
  misc_feature (635)..(635): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacnggctcgtgaggcctcctatgagcctggaccacacgcccacccgtcggtgtccgagtcgtaccccagggaccaggaccgaccgaggtactccaccgtcgcctcgtgacaggtactcggactcggaaccaaagtaactagtcgtacttagttacggtaaccaagagaacgccgacggccgacggtccctggtacgtgtacgtaatataataacgatactaggacgacggtaccctanacggtagaccttccggagtaccggactcgttactcggtacgtccgttacgcgtccgtacgggaacgggtaccagtacgtacgtacgttacgttacggtactcgtactacggtacgtacgtacgacggtacgagggaacgggacgcgtacgtagtaacctagttactagtaacaanaacggtanaacgtaggtagaacgtatagtggtggtacggttcggaggtacggaacgcgtccgacgtcgtacgtgaccgcgaccgacgccncccggccgtccg

SEQ ID NO: 201680 - DNA, 838 bp, Homo sapiens
  misc_feature: GYAE6OF01CFKTJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagctgacacacgcccacccgtggtgtcagtccgtacccgaggacaggaccggcaggactccacctgtccttcgcgacgagtacgtaggaccgtacgaaaccgaaaagtaaatgttagtacgtttaaggttacgtaacccaaacgtaagaaccgaccgacgggaccacccggtcccgttagttaggtttaaggtataagttaattaaacgaacgtaccgtaagtggaaaccggtaccgacccgtacgaaacgtaacggttcccgttaccgaggacggtaccgtttacgttccgttccggtaccgtaccgtaaccctcggtaccgaacggttaacgggactacggtacgttaccggttaccttaacgggttactaaccgttacgtaacggtaggttaccggaaaccggtcggtaacgggaacggaaggaaccgggtagggtaaccgggttactaacggttaacttttagtaacccgttaagaaacgtaaggttaccgtaaagaccggttaaagggttaccggtaacgtttacgtttagggttacggggtttaccggggtacggttaccggggacgggtaccggaaccggttacggacccgtttacccgggaccggttaccggttaacggaccgaaacccggtacccggttaaccgcccggttaccccggccccgtttacccgg

SEQ ID NO: 201681 - DNA, 813 bp, Homo sapiens
  misc_feature: GYAE6OF01ECQFC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctctcactctctgcacgaggctcgtgacggccttacctatgagtcagaccacacgcccaccgtggtgtcaggtccgtaccccgaggacacgaccgggcctaaggctaccaccgttcgcttacgcgagagtaggtcgacgacgaaccgaaaagtaacttacgtgttaacgtttaggtaaccggaacaaaacgtaacgaaccgtaccgaccggtacccgtaccggtaccccgttggttagttaaggtattaaattaaccgtaaagttaaaccgacgtacgttaacggacgtaccgggtaccctacggaagttaccgacgtaccgtaggtaccgtacgttaccggttctcggtaccgtcgttaaccgcgtacggtacgaaggtaccgaggtaccgtacgttacgtacgttacgtactacgttaccggacgtgaaacggtcccgaacgggacgtaacgggtaggacggacggtactacgtaacctttaacgttccggaagtaacctaaacggggtaacgaaggtaaaccgttagggttaaaccggtacttaccggttaggttgggtttaaaccggggttggaacccgggttacggggtaacgaccgttaacgggccgtaccgggttacccggtcgggtaaacctcccgggtaacccggaccggtacccggtttccgaccccggttccggttaaccccg

SEQ ID NO: 201682 - DNA, 748 bp, Homo sapiens
  misc_feature: GYAE6OF01BL3HC.21.46.E02.1.454.CMB.1.raw
  modified_base (294)..(294): a, c, t, g, unknown or other
  misc_feature (294)..(294): n is a, c, g, or t
tcagtcgtcgctcgcacgaccggtgctcgatttagactcatctacagggaaagggggtgggtccaggaggctagaactctgggtgtctcaccatggcctggatccctctacttctcccctcctcactttctgcacagtctctgacggcctcctatgagctcgacacacgccaccgtcggtagtcagtcgtcccaggacaaacggccagactcacctgctcgtggacgtacttcattacgaccaaaagattaagttacgttggttcggttccaagcgagaacggtcgacggaccncggtccccgtagtaccgttacggttcacgttccctagtacggtacggtaccctacgtacggtaccgtacgaccgtccggggacttcccgtacggacgagtaacgtttcgtaccgtcgtccctacgcgtccgtacggacggacgcgtacggtacccgtacgttcgaacttagtacgtgggtccggggacccgtaggggtacggacgttacgtacggtacgaccgttaggaactttacgttacgtttacggttaaacccgaacgtacggtaaccgtaggttaggtacgggacgtacgggtacggtacggggttacgttcggggacggtaacggtaccgtacggttaccggtacccggttccgttcggacgtccggtacccgtagggccctaccggtccccgtccggtacccgtaccgttaccgttcccgtccccgttcccgttccccgttacccgg

SEQ ID NO: 201683 - DNA, 725 bp, Homo sapiens
  misc_feature: GYAE6OF01AMWFG.21.46.E02.1.454.CMB.1.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (481)..(481): a, c, t, g, unknown or other
  misc_feature (481)..(481): n is a, c, g, or t
tcagtcgtcgctcgcacgaccggtgctcgatttagactcatctacagggaaagggggttgggtccaggaggtcagaactctgggtgtctcaccatgggcctggatcccgtcctacttcctcccctcctcacgtctctgcacaggctctgaggcctcgtatgagctgacacacgcctacccgtcggtagtcacgtcgtcccctaggacgacgacgccaggactcaccgtgctcgngcagntggactcggaaccaaagaactagtacgtagttagttacggtaaccaacgtagaacgtcgacggccgacggtcccctaggtgttaagtctaagtactaacaagtactagtagacggccgtcctagacgacgtcctaccgtaggacgtccggtattccgtacgtacgtcctaccgtcggactacgggacggacgaccgtcggtactaccggtacgttacgaccttagtacgacgtacggtaccncggaacggcgtaacggaagaccggtagtacgttacgactttaacgttacgttacgaaaccgtaacgtaacggtaacaacggttaacggtaccgtaacggttacttcggtaaggtttccgggggttgtaccggggacgggtaaccgaacccgggttaacgtccgggacgtaaccccggtttacggtaacggtacccgtacgggtaacccggttaggtcccccttccggggtccccgttacccggg

SEQ ID NO: 201684 - DNA, 688 bp, Homo sapiens
  misc_feature: GYAE6OF01EYNJT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctggaggcctcctatgagctgacacagcccaccctggtgtccaggtcgtccccaggacagacggccaggatccacctgctctgcagatggactgaccaaaagtaatatcgtactttagttacggtaaccaagaggaacgcctaacgggcccaacgggtcccccttggttagttaagtcgaagttaattaaagtaaaagacctacgtaggacggtaccggtccctagaaggtactaccgtccccgtaggaaccgtcgttaacctttccgtacggtccggtacttaccgacgtccgtacggaacggggtacacgtacgaggtttaccctaaggttacgtaacctagttacgacggttaacggaacgttacccgaggtacagggtaacggcgaggtactacgtacttaagtctaacggactaaacgtagaactacgtagtaacgtacgttaactggtagttcgggtacggtcgggtacgggaacgtaacacggtcgtacggtcccgtacgtaggcctacggaccctaaggcccctacccgttccccgtacgg

SEQ ID NO: 201685 - DNA, 764 bp, Homo sapiens
  misc_feature: GYAE6OF01DRY8X.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggtccctcctatgagctgacacacgccacccgtgtgtcagtcgtacccaggacacggacgccgaggactccactgctcgtgacgagtagtcggactacaaaccgtaaaagtaaacttgtgtactttattaccggaaaccaaacgagaaccgaccgtacggaccgtacccggtcccgtagttaggttagtacgtaataaattaaagaaacgtactacggttaagaccggtaccggtacctagaagtaactccgtaccgtgtaaccggtcttaacctttcgtccgtcggtcctaccgtcgttacgacggacggtaccaggaacccgttagtaccgttaacgttacgtaacgtaacgttacggtaaggtaacggtaaaccggttacgacgggaacgaagggcgggacggtaggtaaccgtaggttaactttacgtttaacgtaactaaccgtaaacgtaaggtaacggtaacggttaaggtaaggtaaccgttgttaacgtagggttacgggtacggttacgggaacgggtaccggagtaaccggtgggtacccgtaaccggttcggaaccgtacccggtaccgtaacggcccggtaacccgtccccgggtccttaccccggg

SEQ ID NO: 201686 - DNA, 146 bp, Homo sapiens
  misc_feature: GYAE6OF01C3V4M.21.46.E02.1.454.CMB.1.raw
  modified_base (107)..(146): a, c, t, g, unknown or other
  misc_feature (107)..(146): n is a, c, g, or t
tcagtcgtcgctcgcacgaccggtgctcgatttagactcatctacagggaaaggggtggtccaggaggcagaactctgggaatctcaccatggcctaggaccccttnnnnnnnnnnnnnnnnnnnnnnnnnnnnnnnnnnnnnnnn

SEQ ID NO: 201687 - DNA, 713 bp, Homo sapiens
  misc_feature: GYAE6OF01EL246.21.46.E02.1.454.CMB.1.raw
tcagtcgtcgctcgcacgaccggtgctcgattttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggactccgacctgccttctgacgagagtcggacctacgaaccgaaaagtaaattagtgttactttaacttcggtaacccaaacgtacgaacgccgaacggaccgacggtccccgttggttacgttacgttagtacttaataagtaaaacgaccgtacgtagaacggtcggtacccctacgaacgacgtactcccgaggtacgtcgtacttccgtacgtcggtcctaccgagtaccgtacgaacgggtaccgacgtccggtaacgttaccgaccgtttacgtaactttacgtacgtaacgggttacggtaaaccggttcgaaggaccggaggaaaccgggtacggacggtacgtacgttaacttaacttacgtaagtaaccaaagtacgtaagacgtaaagtacggttacgtacttacggtaggtttacgggcgttacgggacggtacgggactacggtagtacggcccgtagtcggtacgccgacgacgtccgtccgtcccgtcg

SEQ ID NO: 201688 - DNA, 661 bp, Homo sapiens
  misc_feature: GYAE6OF01C500J.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctctatgagctgacacagcccacccgtcggtgtcaggtctcccgaggacagacggcaggatcacctgctctgcagatggactgaccaaaagaaatntgactttaattcggtaaccaaacgagaaaagccgaaggacccacggcccccgttagtagttagtaggaatataaagtaaacgacacgtggaacgacggccctagacgaagcctaccctagagacgttatccttcgtcggctccagtcctacggaacgggacgaagacgtagtaccgtacggtttacgaattacgtctagtaggtaaacgtacccgaaggaccgaagggacgggtaacgaacgggtcttacggtaacttaacgttacgtagtaccaaacgtaagtaacggaactaaggtaggacgttacgttacgtaggtttaggggttcggttacgggacgggtaagggaccgtaaacggtgtacggtacccgttacgtacggactacggaccgagacccgtccggccccgttaccgg

SEQ ID NO: 201689 - DNA, 731 bp, Homo sapiens
  misc_feature: GYAE6OF01AW86M.21.46.E02.1.454.CMB.1.raw
  modified_base (260)..(260): a, c, t, g, unknown or other
  misc_feature (260)..(260): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgacgcctctatgagctagacacacgtcccaccgtggtgtcgagtcgtaccccgaggacaggaccggcgaggactaccaccgtgcctactgctagacttggactacgaccaaagtaattcngtacttagtccggtaacaagacgacgccgagaccacggtcccttgttgttagactagtaacttaagtaacgacctagngaacggcgtacccgtanacgtacgtccgttaccgaggacgtacggtactttcgccggtcgtaccttccggaagtcctacggagggtaaccacggtgtacggtactacgtacgacttanccgttaagngtaccgcggacggacgtaaagggccgaacggtagggtacctcggtaaaccttgtttacgaagttaacccgaaaagggttccaacggaagtagggttaaacccgtaggtttaaaccgtggttaccgggtagggtttcccgggaacgggacccgggggttaacgacggtacccggttacgggtaccgttacccccggttagttaaccggggaaccaccccgggttaacccggaaggtttcccccctcgggtaaccccggtttccccgg

SEQ ID NO: 201690 - DNA, 782 bp, Homo sapiens
  misc_feature: GYAE6OF01E10VI.21.46.E02.1.454.CMB.1.raw
  modified_base (724)..(724): a, c, t, g, unknown or other
  misc_feature (724)..(724): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacgaggcttcgtgacggccttacctatgacgctagaacacagtcccacccgtggtgtaccaggtccgtaccccgaggaccaggaccggtaccgaaggacttcccaccgtcgacttcgtcgactagtagtcggacctacgaaccgaaaagtaatcgtgttactttagtacgtaaccaacgtaagaacgtaccgacggaccgtaccgtcccgttagttacgttagtaggtaattaagtaacgtaaacgacctacggtagaacggtaccggtaccctagtacgtacgtaccgtaccggtaggtacctcgtacttcgtacgttcggacctaccgacgtaccgtacggaacgggtaccgacggtacgtacgtaacgttacgttaacgtaacttaccgtaggtaacggttaacggtaccggtaacggtacggacggtaacgggtaacggacgggttaggacttacggttaaacgtttaccgtacgtaacggttaaccaaacggttagtaacgtacggtaaacggttacgggtaaccggttacgttacgtaggggtttacgggttacgggtaccgggacgggtaacgacggtaccggnggttaaccgtaccgtcggtacgtcggaccgccggacggttcctcccggtcccgtaccg

SEQ ID NO: 201691 - DNA, 890 bp, Homo sapiens
  misc_feature: GYAE6OF01BOCVS.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacgaggctctgacggcctctatgagctcgacacacgaccctacccgtcggtcgtactacgttccggtacccccagggaaccacggaaccggacccgaagggactcctaacccgttgtaccgtacgttcggaacgtaacggtacgtacggtaaccgtacgtaaaaccgaaaaaggttaaaatttacgtacggttaacttttacgttaacgggtaaaacccaaacggaacggtaaacgcccggaaacgtcccggaaccgggttacccgttggttaacggtttagtagtaaacttaagtaaaacgttaaaacggcctaacggtacggaaccgaccgggttacccctaagaacggtaacgttacccgttaacccggagggtaaacctccggtttacgtttaccggttaccggtaccggttaccccaaccgggtttaccggaccggtttaacgggaaaccggggtactaaacggtacccggtaattaaccgggttaaccggttaaacggtaccgttaacgtacggtaaacggttacggaaacggtttaccggaacgggttacgggacgggttaaaccggacgggtaacgtaaccggttacgttaacgttaacgttacggtaacgtaaactaaacggtaagtaacgtaagtaggtaacgtacggttacgtaggtacgtgggtacggtggtaccggaggactacggtacgacggtccgtacggtacgaccgtaccggaccggtacgcctcccgggtccctaccgg

SEQ ID NO: 201692 - DNA, 737 bp, Homo sapiens
  misc_feature: GYAE6OF01A8WYE.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctctcactctctcgcacaggctctgacggtcctctatcgagtctgaaccacacgccctaccgtcggtgtctaggtccgtcccgaggacaggaccgcaggtactcacctgccttgtcgacgagtacgttggacctaggaacctaaaaggtaaacttgttacgtactttacgtacgtaaccgtaacgaacgaccgaccgacggaccgtaccggtaccgttggttacgttagtataacgtaataacgtaacgaacgtacgtacggtacgtaccgtacctagacgtacgtactaccgtagacgtctcttcgtacgtcgtcctacgtcgtacgtacggacgtacgacgtacgtacgtaccgtacgtacgtacgtacgtacggtacgtaacgtacgtacggacggacggaacggacggacgtagtacgtaacgtacttacgtaacgtacgtaacgtaacgtacgtaacgtaacggtagtaacggttacgttacgttacgggttacggttcgggttacgggtaccgggacggtaaccggtacgtacggttacccgaccgggttacggtaaccggttaccggtaccggtaccgtaccggtaccggtcccggtacccgtccggttaccg

SEQ ID NO: 201693 - DNA, 679 bp, Homo sapiens
  misc_feature: GYAE6OF01CXCEC.21.46.E02.1.454.CMB.1.raw
  modified_base (186)..(186): a, c, t, g, unknown or other
  misc_feature (186)..(186): n is a, c, g, or t
  modified_base (264)..(264): a, c, t, g, unknown or other
  misc_feature (264)..(264): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacgaggctcgtgacggccctactatgagctagacacacgcccacccgtggtntcaggtcctacccgaggacaggaccgccgaggactccacctgcctcgtgactagagtcggactgaaacaaaagtaatntcgtattagttacgaacaagagaacgccgacggccgaccgtccgttagtcgttagtagtaataattaaacgtaacgacgtacgtagacgtaccggcctagacgacacctccgaggcgtacgtacttccgtacgtcgaccctacgacgtacgtacggaacgacgacgtacgtacgtaccgtacgttacgaacgttacgtacggtaggttaacgtaaccggcgtacgggaacgtaagggacggacggtacggtataacgtaacgtttaacgttaacgtaacgtaacgaacgtaacgtaacgaaggttaggtaacggtacgtacgtacggtgggtttaggtacgggtcgggaacgacggtacgacgtcgtacggtaccgtacgtacgacgaccgacgacgtcccgtccgtcccgtacg

SEQ ID NO: 201694 - DNA, 744 bp, Homo sapiens
  misc_feature: GYAE6OF01AS75F.21.46.E02.1.454.CMB.1.raw
  modified_base (134)..(134): a, c, t, g, unknown or other
  misc_feature (134)..(134): n is a, c, g, or t
  modified_base (178)..(178): a, c, t, g, unknown or other
  misc_feature (178)..(178): n is a, c, g, or t
  modified_base (318)..(318): a, c, t, g, unknown or other
  misc_feature (318)..(318): n is a, c, g, or t
tcagtcgtcgctcgcacgaccggtgctcgatttagactcatctacagggaaaggggtggtccaggaggcagaactctgggtgtctcaccatggcctggatccctctacttcctccccctctcactctctgcacnggctctgaggcctcctatgagctgacacacgcccacccgtggtntcgagttccgtccccgaggacacggtaccggaccaggactccgaccgtcgctcgtgacagtatcggactacgaacaaaagtaatctgttactttagtacggtaaccaagacgaacgccgacgccacggtcctgttgtagnatataagaagtcacgtgacgacgtccctagacgacgtactccgtagacgtcgtactcgtcgtcgcctacgagtcctaggacggtacaggactaagtccgttacgttagtaccgtagtacgtaagtacggtaacgtacccggaagggacgtaacggggaacgggaaccgggtacggttacgtaaccgttacgtttaccggttaaccgttaaccggtaaacgtaaacccgttagggtaaaccgttacggtaaagggtttaacggtaaccggttcgttacggggttacggttacggggggttacgtccgggggaaccgggttaacgggaaaccgttaccgggttaccggttaaccgggtcccgttaccggtaacgttaccggaccggttacccgaccgggttccgtaaccccgggtccccggttaacgg

SEQ ID NO: 201695 - DNA, 684 bp, Homo sapiens
  misc_feature: GYAE6OF01ASI4V.21.46.E02.1.454.CMB.1.raw
  modified_base (246)..(246): a, c, t, g, unknown or other
  misc_feature (246)..(246): n is a, c, g, or t
  modified_base (399)..(399): a, c, t, g, unknown or other
  misc_feature (399)..(399): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacgagcccaccctcggtgtcagtcgtcccaggacagaccgccaggatccgacctgctctgcagatcggactagaccaaagaatntgactttagtacgtacaacaggaacgccgaggaccacggtcccctggtacgttagtgtaataataagtaaacgactacgtggaacgcggaccctagacgagacctccgtggacacgttatccgtactcggcctacacgtcaacggcgtaccgngaccactccgtacgttacacgttacgacgttgtaaggtacccgtagaaccggtacggaaggaaccgggttacgggacggtacgttaagtaacctttaggttaccgttagtaaaccgtaaacgtagttaacggaacgtaaggttaggacctttcggtaacgttggtacggggttggttaaccggggcgtaacgggtaacgtaccggtccggtacccggttccggtaccgaggttacccgacggtaaccccggtacggaaccccgttcccggtacccccgttccggg

SEQ ID NO: 201696 - DNA, 783 bp, Homo sapiens
  misc_feature: GYAE6OF01BM4S6.21.46.E02.1.454.CMB.1.raw
  modified_base (228)..(228): a, c, t, g, unknown or other
  misc_feature (228)..(228): n is a, c, g, or t
  modified_base (715)..(715): a, c, t, g, unknown or other
  misc_feature (715)..(715): n is a, c, g, or t
  modified_base (725)..(725): a, c, t, g, unknown or other
  misc_feature (725)..(725): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggcctctatgagctgacacagcccaccgtggtgtcacgtcgtaccccaggaccgacggacgccaaggactccgacctgctcgngcgtaagtagtcggtacgtacgaacctaaaaggtaaattacgttcgttactttaacggttacggtaaacccaaaggaacggtaaccggacccggaaccgggtaccgtaccggtaccccgttaggtttacggttacggtaacgtaacgttaacgttaaaacgtaaaccggaactaacggttacgggaaccggtaccggtaccccttaaggaaacgtaccgtaccgttaacccgtaggaaccgttccgttacgtttcccgttacgggtcccggtacccgttaccggtaccggtaccgtacggaacggtaccgacgtaccggacgttacggtacgttacgtatacgtacggtaacggtacgtacgtaccggaggacgtaacgggaacggtacggtacggtacgtacgttacgttaacgtacgtaacgaacgtaacgtagtacgaacgttaaggtacggtaattccgaggttaggttcgggcgggtacggngaaccgggtnaccgtacggtcgaccgtacgtacgacgtacccgacgaccgtccgtcccggccttaacg

SEQ ID NO: 201697 - DNA, 838 bp, Homo sapiens
  misc_feature: GYAE6OF01A0ZF8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacacgcccacccgtcggtgtacagtccgtaccccgaggacgacggaccggaccgtaggataccaccgttggcctcgtgacgaagagtcggactacgaaaccgaaaaagtaaatgtacgtactttaacgttacggtaaaccgaaacgaacgaacgaccggacggaccgtaccggtaccccgttaggttaggttaacggtagtaacttaagtaacgttaaaagaccgtaacggtaggaacggtaccggaccctaagacggaacgtaccgttaccgtagggaacgtccgttaacgttccgtacggtaccgtaccgtaccgaaccgtacggtaccggaaccgggtacgtacgtaccgtaacgttaccgttaacgttacgtaaccgttagtaccgtaggtaacggtaaccggttacgaggaacgagggtaaccggaacgggtacgtacgtaacgtaacgttacgttaacaacggtaaaccgtaagtaacgtaacggtaaccgtaagggttaacggtaacgtttacgtaaggttacggggtttgggtaaccgggtacggggtaaacggtaaaccgggtaaccgtcggtaccggttaccgggtacccgttaacccgggtacgtacccgggtaacccgtacccgggttaaccggaccccgttccccgggtaacccggttacccg

SEQ ID NO: 201698 - DNA, 792 bp, Homo sapiens
  misc_feature: GYAE6OF01DQTDC.21.46.E02.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagactcatctacagggaaagggggtgggtccaggaggcagaactctgggtgtctcaccatggcctggatcctctacttctcccctctcactctctgcacaggctctgacggcctctatgagtctgacacacgcccaccgttcggtntcagtccggtccccgaaggacacggaccggccgaaggacttccaccgttgccttcgtagacgaagagtcggacctacgaaccgtaaaagtaaacttattacggtacttttaacgttacggtaaaccaaacgacggaaccgtacccgacgggacccgtaccggtccccgtttggttacggttaagtacgtaatttaagtaaacgttaaacgaacctacggttagggaaccggtaccggtacccctaggtaaacggacgttaacccgtcccggtaggaacgccgtttacgttccgtacggtcgacccctacgaccgtcgtacggaacgggccaacggtacgttacggtaactacggttaactacgtactacggtaaggtaccgtaacggtaccgtacggaacgtaacgggacgggtacgtacggtacgtaacgttacgtttaacgttacgtaacgtaacaaacggtagtaacggtacggtaggtaacgtaacgttcgtaacggttgggttacggtacgggtacggggaacggtaacggtaccgtacggtcccgtacggtaccgtaccggtacggacgtacccggacgtaaccggccgttcccgcccggttaccgg

SEQ ID NO: 201699 - DNA, 766 bp, Homo sapiens
  misc_feature: GYAE6OF01ERFQJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacacgcccaccctcggtgtcagtcgtccccaggacacgacggcaggactcacctgctctgacagtatggactcgaaccaaaagtaaatagtgtactttaagttacgggtaaccaaacgaacggaacgcccgaacggaccgtaaccggtcccccgttggttacggtttaaggtacgtaatttaagttaaacgttaaaacgaccgtaacgtagggaacggtaccgggcccttacgaacgacgtacctcccgtagacgcgtacttccgtcgtacgtccacgacgctacggaacgggtacacggtactacggttaccgtaacggttacggtaccttagtaccgtaagggttacgtaaccggttacccggaagggtaaccgtaagggaaccgggtaacgggacggtcttaacggtactttaacgttacgtaacgtaaccaaacgtaagtaacgaacgtaaggttaacgttaacggttactacgttagggttcgggttacggtaccgggtacgggaacgggtaacccgtaggtacggtaccggtaccggttaccgtacggacccgtaaccggacccgtacgggtccccgttcccggccccggttacccgg

SEQ ID NO: 201700 - DNA, 867 bp, Homo sapiens
  misc_feature: GYAE6OF01A8PWQ.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctatttcctccccctcctcactctctgcacaggctctgacgcctctatgagctgacacacgccacccgtcggtgtcacgtccgtaccccgaggaccacgaccggccgaaggactaccacctggcctcgtacgcgtaagacgtacggactacgaaacctaaaagtaaaattcgttacggttacttttaagttaccggtaaaccgtaacgaacggaacgtacccggaccggacccggtaccggtacccccgttaggtttacggttagttaaggtaacttaacgttaaacgtaaaacggaccgtaacgttacggaaccggtacccgggtacccgttacgaaacggtacgtaccgttacccgtaggtaccgtacgttaacgtttccgtaccggttccgtacccgtaccgacgttacccgacggtaacgggacgacggtacctacggttaacccggtacggtttccgtaaacgtacgttacgtaacgggtaaccggttaaccggtacccggaaacgggaaccgtaacggggtaaacgggtaccgggtaaggtaccgttaacgggttaaccttaaggttcccgttaacggtaaactaaacggtaacgtaacggtaacggtagttaaccggtacgtttacgtagtacggttacgggttcgggtaaccgggtacggacggaaccggtacgtacccggtaccggttaccggtacgttacccggaccgtaccggtaccccggagttccccgtacccggtccccgttaaccgg

SEQ ID NO: 201701 - DNA, 791 bp, Homo sapiens
  misc_feature: GYAE6OF01C8WKB.21.46.E02.1.454.CMB.1.raw
  modified_base (85)..(85): a, c, t, g, unknown or other
  misc_feature (85)..(85): n is a, c, g, or t
  modified_base (228)..(228): a, c, t, g, unknown or other
  misc_feature (228)..(228): n is a, c, g, or t
  modified_base (409)..(409): a, c, t, g, unknown or other
  misc_feature (409)..(409): n is a, c, g, or t
  modified_base (448)..(448): a, c, t, g, unknown or other
  misc_feature (448)..(448): n is a, c, g, or t
tcagtcgtcgctcgcacgaccggtgctcgatttagactcatctacagggaaagggggtgggtccaggaggcagaactcgtgggtntctcaccatggcctggatccctctacttctcccctcctcactctctgcacaggctcgtgacgcctactatgagctgacacacgcccaccgtcggtgtacacgtaccgtacccaggaccaggaaccggccaaggactccacgtnacctcgtggacaagtagacggaactagaaacctaaaaaggaattagtgtaactttaacgttaccggaaaccaaggaagaacgacccggaagtacccaccggtaccctagttaggtacgtagtaaacgtaaataaagtaacgacctagtacgacgacggcctaagacgtaagcctaccggtnacggtatactttaccggtgtacgcctacctaggtaccgnggaacgagaacccgttgaacgtttaccggaaagtttacggtaacttaccggtagttaaacgtacggttaaaccgggaccgaaggtaacgaaacggggacccggaagacggtacggttaacaacgttttactaaacggttaacgaaacctaaagggtaaccctaaaggttagaaaaccgggttctaaacggttacgttaccgggttaggttttacgggtacccgggtaacgggaccgggaacctaaggaaccggttaccgaccgggttaaaccgtaaccgggtacgaaacccgtacccggaaaccggacgggaaacccccttccggggtaaccccgttaaacgg

SEQ ID NO: 201702 - DNA, 783 bp, Homo sapiens
  misc_feature: GYAE6OF01CLDVN.21.46.E02.1.454.CMB.1.raw
  modified_base (164)..(164): a, c, t, g, unknown or other
  misc_feature (164)..(164): n is a, c, g, or t
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacngccaccctcggtgtcagtcgtcccgaggacaggacggccaggactccacctgctctgacagntggactagaaccaaagaaatntgtacgtttaagttacggtaaccaaacgaaggaacgtccgaacgggaccgaaccggtcccccgttaggttacggtttaaggtagtaacgttaaacttaaagtaaaacgtaacgaacgttaaggacggtaaccggtacccgttacgaacggtaacggtaccgttaccccgtaggtaacgtaccggttaactttccgttaccgttacgggacccttaccggacggtacccgtacggaacggggtaccgaacgtcgtaacgttacccgtaacggttacgtaaccgttaagtccgtaaggttaacggaaccgtaccggaacgggacgtaaagggaccggacgggtacggtacgttacgtaacttacgtttaacgtacgtaacaaagtacgtaagaacgtaaggtacgtaaggtacttaggtaggttacgggttacgggtaccggagggaacggtaaccgtacggtaccgtacggtaacccgttccggtaacgtaccggacccgaacccggttagcccggttccccggaccccgttaccgg

SEQ ID NO: 201703 - DNA, 704 bp, Homo sapiens
  misc_feature: GYAE6OF01EZVQJ.21.46.E02.1.454.CMB.1.raw
  modified_base (282)..(282): a, c, t, g, unknown or other
  misc_feature (282)..(282): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctggacgcctcctatgagctagacacagcccacccgtcggtagtcagtcgtccccaggacagacggaccaggactcacctgcctcgtcgcagatcggactcgaaccgaaaagaaactagtagtacgttagtacggtaaccaanaagaacgccgaggccgacggccccttggtacgttagtgaatagttaacaaacggacctagtaggaacgacggtaccctagaaggacgtactccgaaggtacgtctactttctcgtgtacctcgacgtcgtacgagggacctagacgtacgtaccgtacgttacgactacgttacgagtacggtaacgtccgaagggacgaacgggtaacggacggaaggttccgtagtaacccttagttacgtaacgtaacaacggtaaggacgaacgtaagggttacgtacggttaactggtaacgggtttcgggtaggtccggggaaagggtaaccggaacgtacggtacggtacccggttaacccgttccgggtaacgtacccggaaccgggtaccctaaccggggccccttccccggccccgttacgg

SEQ ID NO: 201704 - DNA, 743 bp, Homo sapiens
  misc_feature: GYAE6OF01EMLXI.21.46.E02.1.454.CMB.1.raw
  modified_base (154)..(154): a, c, t, g, unknown or other
  misc_feature (154)..(154): n is a, c, g, or t
  modified_base (505)..(505): a, c, t, g, unknown or other
  misc_feature (505)..(505): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctctatganctgacactagccacctggtgtcagtcgtcccaggacagacggcaggactcacctgccttctgacagtatggactcgaaccaaaaggtaattatcgtactttacgttacggtaaccaaacgtaaggtaacgacccaacgggtccgaacggtacccccgttggttacggttaagttacgtaactaagttaagtaaaaacgactaacgtacggtacggaccggtacccttacgaaggtacgtaaccttaccgtacgtacgtacgtaacgtttcgtccggttacggtccttaccgacggtacggaccggtaacgggacacgggtactaacggttacctacggtttacgaaccttntaccggtaagtacgtaaacggttcgacgggtacaacgggtacggacggtacggcgtttaaccgtaacttagttaccggtactaccgtaaagtcggtaactaacggtagtacgtaacggtaacttggtaacggtttgggcggttaccgggtaccgaacggttaccgaggtccgttaacggtcccgttacggtaaggccgtaaccggtacccgaggtcccgttcccggcccggttaccgg

SEQ ID NO: 201705 - DNA, 729 bp, Homo sapiens
  misc_feature: GYAE6OF01EE5OE.21.46.E02.1.454.CMB.1.raw
  modified_base (178)..(178): a, c, t, g, unknown or other
  misc_feature (178)..(178): n is a, c, g, or t
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtntcagtcgtccccaggacaggaccgccaggatcacctgctctgcagatggactgaccaaagaatntgtactttagttacggtaaccaacgaagaacgccgacggaccaccggtcccctggtcgttagtagattataataaagacacgtgacgacggccctcgagacgtactcccgtagacgtacgtatttccgtcgtacggtcccttaccgacgtccgtacgtacggggaccagtacgtacgtacgttacgttacgtacgttaacgtacgaaggttacgaacggttcccgaagggtacgaagggacgggacgggtacggacgttacgtaactttaaccgttacgtacgttaacaaaaccggtagtaacggtaaacgagggttaacgtaacggttaccgtacgtagggtttcgggggttacggttaccgggggaccgggtaacgggtaacccgtagggttaccgttaccggtacccggttaccccgttagggtacccacccggggtaaacccgtacggttccccggtacccccggtccccccgggtttaccgg

SEQ ID NO: 201706 - DNA, 593 bp, Homo sapiens
  misc_feature: GYAE6OF01CXC5A.21.46.E02.1.454.CMB.1.raw
  modified_base (234)..(234): a, c, t, g, unknown or other
  misc_feature (234)..(234): n is a, c, g, or t
  modified_base (407)..(407): a, c, t, g, unknown or other
  misc_feature (407)..(407): n is a, c, g, or t
  modified_base (430)..(430): a, c, t, g, unknown or other
  misc_feature (430)..(430): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
  modified_base (475)..(475): a, c, t, g, unknown or other
  misc_feature (475)..(475): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccacccgtcggtgtcagtcgtccccaggacagacggccaggactcacctgctcgtgcagatcggacngaccaaaagaatgtacgtactttagttacggaaccaaacgagaaacgccgaacggaccgaacggtcccctaggttagttaggtagaattattaaacgaaagtacctacgtgaacgtacgccctagagagtactccgtagacgtcgtattctcgtgctcgagtctacgaggacngacgagtacgacgttagacttancagtgaactcgagacgagagacgagnagactatantacaatgtanacgagtagagttacacgagtttgggcgttcgggacggtaaggaccgtaacggtcgtacggtaccgtccgtaacggcctaacggacccgtaaaggtccctaccggtcccccgttaccgg

SEQ ID NO: 201707 - DNA, 857 bp, Homo sapiens
  misc_feature: GYAE6OF01BKEPP.21.46.E02.1.454.CMB.1.raw
  modified_base (170)..(170): a, c, t, g, unknown or other
  misc_feature (170)..(170): n is a, c, g, or t
tcagtcgtcgctcgcacgaccggtgctcgatttagactcatctacagggaaagggggtgggtccaggaggcagaactctgggtgtctcaccatggcctggactccctctacttcctcccctctcactctctgcacgaggctcgtaggacgcctctatgagctacgacacncgccctaccgtcggtgtactacggtccgtacccgaggaccacggaccggcgaaggtactccgtacgtcgtcttcgagacgaagtacggtacggaccgtacggaaactaaaagtaacgttgtacgttacgttttaacgttaaccggaaaccaaagtaacggaacccgaccggtaccggaccgtacccgggttaccgtttaggtaaggtttaacgtacgttaaaagtttaacgtaaaacggtaaaccggacctaacgggttaggaaccgtaccggtcccttaaggaacgtaccgtaccttccggaagtacgtacgttacgttcgtaacgtccgtaccgtacgacggttaccgtaacgggaacggacctacggtaacgtaccggtaccgttaagtaccgtaagttacgtaacggtacgtaacgaacggtcgggaagtaaccggaagggtaccggacgacggtacgttaacgtaagtttaacgtacgtaactaaacggaacgttcgtaacgtaaggtacgttaacggttaccttacgtacgggtttacggttacgggggttaacgggtaccggggtaacgtaaacccgggtaacgtaccggtacccgggttacggtacccgggttaacggaccgtaacgggcccggtaacggtaacccggttcccccgtaccgtccccggttaaacccggg

SEQ ID NO: 201708 - DNA, 1146 bp, Homo sapiens
  misc_feature: GYAE6OF01BH8UV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctggacggcctctatgagctagacacacgccctacccgtggtcgtactagtccgtaccccgaggacacggacggaccgaggactccgacctgtcctcgtcgacgtagtacgttcgggaacctaccgtaaaccgaaaaaaggtaaacttagttacggtttaacgttttaacggtttaaccgggtaaaccccaaaaaccggttaaccgggaaaacccggaccccgggaaaccgggtacccggaaaccccgggggttccccccttttagggggttttaaccggtttaaccggttaaggttaaaacgtttaaacggttaaaaacgttaaaaacccggaaccgttaaaccgggttaacggtaaaccgggggtaaccccgggtacccccttaacgggaaacgggaaaccggttacccgttccccgggtaacgggtaaccgggtaccgtttaacccggtttccggttacccgggtacccggggtaccctacccggtaacgggtacccgttaacggggaacggggaaaccgtaccggtaccggttaaacggttaacccgttaacgggtttaaccgaacgtttacccgggttaactaaccgggggtaaccgggttaaccggtaaccccgggtaaacgggaccggtaaaggggtaaccggggtaaccgggggtaaccggttacccgggtttaaacgtaaccgttttaaaccgtttaaccgggttaaacctaaaccgggttaaaaccggtcgggttaaacccgtaaaggggttaaaacggttaaacccggggttacggttaaacccggttaagggtttaccggggttttacggggtaccggggtttaccccggggggaaacgggtaaacccgggggttaaaccctaacggggttacccgtttaacccggggaccccggggtttaaccggttaaacccgggtaacccggggtaaccccgggtaaccccgggttaacccggggccccggtttccccccggtaccccccgggttaacccgg

SEQ ID NO: 201709 - DNA, 967 bp, Homo sapiens
  misc_feature: GYAE6OF01CXGAF.21.46.E02.1.454.CMB.1.raw
  modified_base (260)..(260): a, c, t, g, unknown or other
  misc_feature (260)..(260): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctctactttctgcacagtctctgacggcctcctatgagctgacacagcccacctcggtctcgagtcggtccccgggaacaaacggccaggactcaccgtgctcgtggagagtgactattacgaaaccttaaaaaatttntttggttttttacgaaccagcgaagaacgtacgacggaccgtacggtccccgtggttacggtttcggtacctactaccgtaaggtacggaacgggaaccggtaacgggaacgaaccccgtacccccggtaccggggtacctacccggttaggaacgtaaggtacgttttccgtaccggtcggtaccccgttaaccgaaacccgttacgggtaaaccgggggtaaccggggttcgggaccccgttaaacgggtttacgttacgtttaccggacggtaacgggggtcccgggggtacccggtaagggggttaacgggagggttaagttacgggaaaccgttcgggttaacggtaaaccggtttaactttaaccgtttacggtttaaaccgtacgtaacggaacgtaacggaacgtacggaccgttaaggttacggtaccgtaaacggttaccggggaacgggggtacgttaaccggggttacccgggggaacggggttaaaccgggtaacccgggtaaccgggggtttacgtaacccggggtttaccgttaacggggttacccgaaaccccggggttaccccgggaaccggtccccggttaacccccggtccccccgggttacggttaccccgttaacccccggtttcccgggtttacccccgttcccccccgggttacccctcccccggttttcccgttacccccggg

SEQ ID NO: 201710 - DNA, 840 bp, Homo sapiens
  misc_feature: GYAE6OF01D95QN.21.46.E02.1.454.CMB.1.raw
  modified_base (429)..(429): a, c, t, g, unknown or other
  misc_feature (429)..(429): n is a, c, g, or t
tcagtcgtcgctcgcacgaccggtgctcgatttagactcatctacagggaaaggggtgggtccaggaggcagaactctgggtgtctcaccatggcctggactcctctacttcctccccctcctcactctctgcacaggctcgtgacggcctctatcgagtcagacactacgcccgacccgtggtctacgtacggttccgaccccgaagggaccgacgggacccggtccgaaaggtacctaccgaaccgttcggccttacgtcggaacgtaagtacggtacgggaaccttacgggaaaacctaaaagttaaacgttcgttcgtttaacgtttacggttaaccggaaaaccaaaggacggaaccggtccgacggtaccgtaccggtccgttaggttacgttagtactaattaacgtaaataacgctaaggngacggtcgacctagagtactctaccgtagacgtacttacgttctacggctcctacggtcgaccgtagaacggtctagacgtaacgttcgtaacgtacgtacttagtaccgtaaggtacaacgttacggcgaacggtacgggaaacggtcggtaggttaccgttaagtaacttttaaccggtacgtaaccgtaaccgtaaaggtaacgtaggtaacggtaacgggtttacgtaacggttcggttagttacgggggttagggttacccgggaacgggtaaacgggtacccgggtaaaaccggtacgccccggggtttaacccggttaacgggttacgggtacccgggttaaacccggccgtaaaccccggtccggtttaacccccggtcccggggttcccttaacccccgggg

SEQ ID NO: 201711 - DNA, 818 bp, Homo sapiens
  misc_feature: GYAE6OF01AVV44.21.46.E02.1.454.CMB.1.raw
  modified_base (127)..(127): a, c, t, g, unknown or other
  misc_feature (127)..(127): n is a, c, g, or t
  modified_base (522)..(522): a, c, t, g, unknown or other
  misc_feature (522)..(522): n is a, c, g, or t
tcagtcgtcgctcgcacgaccggtgctcgatttagactcatctacagggaaagggggtgggtccaggaggcagaactctgggtgtctcaccatggcctggactcctcctacttcctccccctcctcnctctctgcacaggctctagacggcctcctatagcgctgacacacgcccaccgtcggtgtacacggttaccgtccccgaaggaacgacggacccggaccgaacgggactaccctcgtcgtaccgtacgtgacgtaaggagtaccgaccgttaacgaccgaaaagtaaagtactacgtacgttttacgtaaccgtaaccgtaaacgaacgacgaccgtaacgggacctaccggtccgttagggttcttaaggtactaagtaactttaaagaaaccacgtaacgtacggacggtaaccggtcctacgaaacggaggttaccctacggtacgacggttactccgttacgtcccgttaggaacctccggtaacgtaccgggtaacgtaccggggtaaacnggtaccctacgggtttaacgaccggttacgttaacctaagggtagtaaaccgggttaacgaccgttaaccggagggaacgaggtaacgggtacggacgtacgtactacgtactaacgtataacgtaacgaacgtaaggttaccgtaaggtcggtaaagtccgttaaacggtcggtttaccggggaagttaccggggccgggtaaacggtaccgtaacgttcccgggtaaccggtcccgggttagaaacgtaccggtaacggacccggttagcccgttaccccggtcggtaaacccg

SEQ ID NO: 201712 - DNA, 751 bp, Homo sapiens
  misc_feature: GYAE6OF01CYNEY.21.46.E02.1.454.CMB.1.raw
  modified_base (142)..(142): a, c, t, g, unknown or other
  misc_feature (142)..(142): n is a, c, g, or t
  modified_base (239)..(239): a, c, t, g, unknown or other
  misc_feature (239)..(239): n is a, c, g, or t
  modified_base (341)..(341): a, c, t, g, unknown or other
  misc_feature (341)..(341): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctcngaggcctcctatgagctgacacagcccacccgtggtgtcagtccgtaccccaggacacggaccggccagggtactccaccgtgccttctggcacggntcgggacctcgaaccgaaaagtaatgtcgtacttagttacggtaaccaacgtagaacgaccgaggaccgacggtccccgttggtagttagataattaataanaaagacacgtaggacggacgaccctacgtaggactacctccgtaggacgtccgttattcctacggtcggtccctaccgacggttaccacgggaacgggactacggtacctacggttaccgtaacggtttacgaacgttactacggaaggttacgtaaccggtacgacgggaacggaaacgggacgggaccggacggtcgtaacggtactttaagttaaccggtagttaaaccgaacggtataacgggaactaacgggtaggttaccgtaacgttaccgtaggggttttcggtacccggggttacggggaaccgggttaacgggaaccgttaacggccgtaaaccgggtccgtacccggttagacccgtaccggtacccgacggtacccgttccccggtacccgtacccgg

SEQ ID NO: 201713 - DNA, 783 bp, Homo sapiens
  misc_feature: GYAE6OF01AE0J3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctcctatgagctgacacagcccaccgttcggtgtcagtcgtacccgaggacacggacggccaaggtctacctaccgtgccttcgtaggcagtagtcggactcgaaccgtaaagtaaaacttgtcggttacctttagttaaccggtaacctaaacgtacggaaccggacccgtaaccggtcccgtaccggtcccgtaggtttggtttaggagttattaaacgtaagaaacgtcacggtaggtaccggacggtaccttgaacggtccgtaccgtccggtaagaccgtcggtaactttccgtagtccgggacctccgacgtaccggtacgacggggttacacggtaccgtacgggtaccttacggttacgtactacggtacacggtaacggtacgacgacggtacggtaacggggacgtaccgggtacgacgttaaccgtacgttaactttccggttaacgaaaccgttaacgaacggtacaaacgggtagttagggtaaccttcgttaacgggttagttacgggggtaccggttacggggaaccggggtacgttaacccggcgtacggttacccgggacgttacggtacccgtcgacccggttaacggaccgtccccgtccccgggtccttacccgggg

SEQ ID NO: 201714 - DNA, 729 bp, Homo sapiens
  misc_feature: GYAE6OF01CCOVM.21.46.E02.1.454.CMB.1.raw
  modified_base (181)..(181): a, c, t, g, unknown or other
  misc_feature (181)..(181): n is a, c, g, or t
  modified_base (227)..(227): a, c, t, g, unknown or other
  misc_feature (227)..(227): n is a, c, g, or t
  modified_base (708)..(708): a, c, t, g, unknown or other
  misc_feature (708)..(708): n is a, c, g, or t
tcagtcgtcgctcgcacgaccggtgctcgatttagactcatctacagggaaagggggtgggtccaggaggcagaactctgggtgtctcaccatggcctggatccctctacttcctcccctctcactctctgcacaggctcgtgaggtccctctatgagctagacacacgcctaccgtggtntcgtagtcgtacccgaggacaggacgctaggactacacgtgctcgngacagtatcggactcgaaactaaaagaatatcgtacttagtacgtaaccaaacgtagaacgccgaacggtccgtaccggtaccgtaggtagttacgtagtaacgtaacgtaaacgtaaacgaacgacggtacgaacgggtaccggtacctaacgacgtaacgtaccgtccgtaagcggtaacttacgttcgttaggtaccgtacctagtaccggtacgacgaacgggacacgtaacgtacggtccgttaacgtataagttaccgtaggtaacgtaaccggtaaacgtaccggtaacggaacgaaagggtacgggactacggtaacttaacgttaaacgttaactacgtaacggtaaacctaaggaagtaacgaacgttaagtaaggacgttacgtagttacgggttaggtcggtaccgggtgaaaccgggtacgacggttaccgtaacggtaccgtaggtaaccggacgtaccgtaaccgnggaccccttggtcccgtaacg

SEQ ID NO: 201715 - DNA, 745 bp, Homo sapiens
  misc_feature: GYAE6OF01B6OEN.21.46.E02.1.454.CMB.1.raw
  modified_base (140)..(140): a, c, t, g, unknown or other
  misc_feature (140)..(140): n is a, c, g, or t
tcagtcgtcgctcgcacgaccggtgctcgatttagactcatctacagggaaagggggtgggtccaggaggcagaactcgtgggtgtctcaccatggcctggactccctctaccttcctcccctcctcactctctgcacgnggctcgtgacgcctcctatgacgctgaacacgaccgcccaccgtggtctcgacgtccgacccgaaggacacggaccggacgaggtactaccgccgtcgtcctagtcgacgaagtgacggtaacctacgaaacctaaaaagtaaattgttacgtttacgttaaccggttacggaaaaccaaaggaacggtaaaccggccggaaccgggaccgaccgggttccccttagggtttacggtttaagtaacgtaaataacgttaaaagtaaaccgactaacggtacggaaacggtccgtaacccgataacgaaccggtacctaccggtgacggttacctacgttcgtcggttcggacctacgtacggaccgtacggaaggaccaggtctaacggtctagttacgatacgtacgcgtaagtacgcggacggtacgaaggacgacggtatacgtagtactagttactaacgtaacaacggttagaactacggaagtaacggtagtacgttggtagggtcggtacggggaccgtacgggaagtacgaacgttcggtaacgtcgtacggtacgtaccgtaccgaacggttcccgtcgccccgttcccgtaccgg

SEQ ID NO: 201716 - DNA, 745 bp, Homo sapiens
  misc_feature: GYAE6OF01C5Q76.21.46.E02.1.454.CMB.1.raw
  modified_base (211)..(211): a, c, t, g, unknown or other
  misc_feature (211)..(211): n is a, c, g, or t
tcagtcgtcgctcgcacgaccggtgctcgatttagactcatctacagggaaagggggtgggtccaggaggcaggaactctgggtgtctcacatggcctggatccctctacttcctcccctctcactctctgcacgaggctcgtgaggcctctatgagctgacacacgcctaccgtggtgtcagtcgtcccgaggaccagacggccaggacncgactgctcgtacgacgagacgtaggactacaaccgaaaagtaatcgtgttacttagttacgtaacaacgaagacgccacggaccgtacggcctaggtgttacgtagtaagtataaagtaacgaccgtagtacggaacggaccggtacccacggtaacgaacgtacccgtaccgttaggaacgtaccgtagttcctacgtacggctttaaccggactaccggtacggaacgggaccgactaccgtaacgttaccgtacgtacgtaactacgacgtaacgttacgaaccgtagaaggacgaaggaaccgggatacggtcgtaactacgtttaagttaccgtaacgtaacgaacgtaacaacggtaacgtaaagggtacgtacgggtaccttaacgggttaggttacggggttacggtacgggtaaccggtaacggaaccggttaacggtccgttaaccgggtaccgttaacgggttaccgtaccgtaacccgggaactaccccgggttaccggtaccccggttccccggtaacgg

SEQ ID NO: 201717 - DNA, 924 bp, Homo sapiens
  misc_feature: GYAE6OF01AL8CH.21.46.E02.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcanggctctgacggcctctatgagctagaccacacgccctacccgttcgggtgttcctaacggtccgtacccccgagggaaccgaacgggtacccggaccgagggtaacctcccgtaaccgcggtcccttcgttcggaccgaaggacgttacggggaaccttacggaaacccgaaaaaggttaaaacttgttacggttaccgttttaacggtttaacgggtaaaccctaaacggaacggaaaccggtacccggaacggtaccggtaccgggtccccgttaggttaggttacggtaggtaactaaacgttaagaaacgtaacctacggtacggaacgaccggttacccgacggtaacgtaaccggtaccgttaccggtaaccgtacggtacgtttaactttccggtaacggtccgggtacctacccgggtagttaccggaccggttacgggaacgtaaaccggttccgtaggtttaccgttaacggttaacgttaccgtaaggttacgtacgggtaacggttacggtaaccggtacgggaaacggacgggtaaacggacgggtacggttaccgtaacgttaacggtttaacttacggtaacgtaaccgaaacggtaacggtacgtacggtaacgggttacgtaacggttacgttagttaccggggttaggttacgggcggaaacccggggtagtaaccggtacgacgggtttaacggtccgttacgggttaaccacggggtacccgacggtttaacccgggtcccggttaaaccggtcccccgggttaaaccg

SEQ ID NO: 201718 - DNA, 600 bp, Homo sapiens
  misc_feature: GYAE6OF01AYX8I.21.46.E02.1.454.CMB.1.raw
  modified_base (219)..(219): a, c, t, g, unknown or other
  misc_feature (219)..(219): n is a, c, g, or t
  modified_base (335)..(335): a, c, t, g, unknown or other
  misc_feature (335)..(335): n is a, c, g, or t
  modified_base (410)..(410): a, c, t, g, unknown or other
  misc_feature (410)..(410): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagaccggccaggatcacctgctcngcagatggactgaccaaaagaatatgtaccttattcggtaaccaaacaggaacgccgaacggccaaggccccctggtgttacgtgaatataataaagacactgaggacggccctanaagagactccctagagcgattctaccgtggacctccgagcctcgaagggacaggctaggtcacggttagacttanctacggtagaacggtcaaggcgaggaaggacgaggtctacggaacttattacgtagtaaccaaacgtagtaagaactaagggtagaacgttactacgtagttgggtgttaccgggcgggacggtaccgtagtacgtcggacccgttaccgtaggtcgaaccggcccgaaggcctcccgccccggtcccgg

SEQ ID NO: 201719 - DNA, 913 bp, Homo sapiens
  misc_feature: GYAE6OF01BQXLI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgccacccgtcggtgtcagtcgtcccgaggacagacggccaggactcacctgctcgtgcagatggactgaaccaaagaatagtcgtactttacgttacggtaaacccaaacgaacggaaacgcccgtaacgggacccgtaacccggggtcccccgttagggtttagtttaagggttaggtaaactttaaacgttaaacgttaaaaacggaaccgtaaaccgttaggggtaaaccgggaaacccgggtaccccgttaaccggaaaacgggtaacgtaaccccgtttccccgtaaggtacggtaccggtaactttccgttccgggttcgggtacccctcgaaggtcccgtaacgggaacgggggtaccctaggggtaaacccgttaggttaaccccgggttaaccggtttacggtaaacccggttaactttaccggtaacgggtttaagggtaaaccgggttaccccgggaaagggtaacccgaaaggggggtaaccggaacccgggggaaggggtttaccctaaaggggttttaaccctttaaacgttttaaccggtaaccggttaaacgaaaacccgggttaagttaaaacccggtaaaggtacggttaaacggttaacgggttaccttagtaacgggttttcgggtagggtttaccggggacgggtaaaccggacgtaaaccggtcgtaccggtacccgttagtacggaccgtacgtcgggaacttccgtaccccggccccgtttacg

SEQ ID NO: 201720 - DNA, 725 bp, Homo sapiens
  misc_feature: GYAE6OF01ECC4O.21.46.E02.1.454.CMB.1.raw
  modified_base (86)..(86): a, c, t, g, unknown or other
  misc_feature (86)..(86): n is a, c, g, or t
  modified_base (119)..(119): a, c, t, g, unknown or other
  misc_feature (119)..(119): n is a, c, g, or t
  modified_base (147)..(147): a, c, t, g, unknown or other
  misc_feature (147)..(147): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (239)..(239): a, c, t, g, unknown or other
  misc_feature (239)..(239): n is a, c, g, or t
  modified_base (244)..(244): a, c, t, g, unknown or other
  misc_feature (244)..(244): n is a, c, g, or t
  modified_base (342)..(342): a, c, t, g, unknown or other
  misc_feature (342)..(342): n is a, c, g, or t
  modified_base (368)..(368): a, c, t, g, unknown or other
  misc_feature (368)..(368): n is a, c, g, or t
  modified_base (432)..(432): a, c, t, g, unknown or other
  misc_feature (432)..(432): n is a, c, g, or t
tcagtcgtcgctcgcacgaccggtgctcgatttagactcatctacaggggaaagggggtgggtccaggaggcagaactctggggtntctcaccatggcctggactccctactacttccnccccctctcactctctgcacaggcttcnggacgtcccttcctatgagtctagaccacgacgaccctccgtcggtntaccnggtccgtacccgaaggacacgggaaccggcaggtcaaccnccgtntcctaacgtcgcgtaagtcgacggccctaaggaaaaccaaaagttacttagacgtttacgtttacgtacgaaactacgaacgtaacgccgcggtaccncggtccgttggtaaggttattaagtntaaacgtaaacgttaaacgacgtagtcggaaccgaccgtacacgacgtactccgtaacggtcgntacgtcttcgagtcctacgacggtccaacggacgtaacggtcaacggttcgaaccgttacgtacgtacgtacgtaacgtaccggaagtccgtaacggacggaacgagggtaccgtacgggaacttagtacgtacgttaacaagttacgaacgacgtaaggaacggtacgtacgtaaggtacgttacggtacgttacggacgggttcggaccggtagaccggtacgtaccgtaccgttacgccgttaccgaacgtccgtacccgaaccgttacccgtccttccggacccttccg

SEQ ID NO: 201721 - DNA, 891 bp, Homo sapiens
  misc_feature: GYAE6OF01B12Z2.21.46.E02.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctcctatgagctgacacagccacccgtggtntcagtcgtcccgaggacaggacggccaaggatccaccgtgcctctcgcagagtcggacctggaacctaaagtaatattcgtactttagtttacggtaaccctaacgaaggaacgacccgacgggtacccgaacggggtccccccgttagggtttcgtttaaaggttcggaactttaaacgttaaagttaaaaaccggacctaaccgtttgggaaacggaacccgggtcccccttaaggaacggtaacgaccgttaccccgtaggtacggtaccggtaacttttcccgtcggttaccgggtcccttacccgtacgggtaccttaccgggaacggggtaacccagggtacctaacgggtttaacccaccgggttttaaccggtaacgtttaaccgttaccggttaacggggtaaccggtaaaaccgggttccccgaacggggtacgaaacggggacggggtaaccgaacggggttccctaagggtaaacccttttacgtttaacccggttaactaaaaccgggtaactaacggttaaacggtaaccgtaagggtttaaacggtaaccgtttacggttaccgtttagggttagggtttccgggtcgggggtaacggtacgggtaacccgtacgggtcgtacccgggttaacccggttccgtaacgggtccggacggaccccggaagggttccctacccccggttaccccggttccgg

SEQ ID NO: 201722 - DNA, 765 bp, Homo sapiens
  misc_feature: GYAE6OF01DGZ33.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacgagctctgacggccctcctatggagctagacacacgcccacccgtggtctcagtccgtccccaggaccaaaccggccaggactccaccgtgacctcgtgggagatcgactacttacgaaaccttaaaaatttgtttaggtttttacgaccagaacgagtaacgtcgacggaccgaccggtcccgttggttcgttcggtacacgtaccgtagtacggaagtaacggacggacgacccggtacccggtaccggtactccgtagagtacgtacttcgtcgtcgactaccgtaacgtcggtaacgggtcggtcgtaccgtacgttacgtacgttcgtacggtacgggtcgggacccggtagggtacggaacggtacgtacggtaacgtacgtacgtaaccgtttacgttaacgttacgttaccgtagacgtacgacgaacgtaggagtaccggttagacgtacggtacgggacgggtacgtacggtcggggaacggacggtaccggttacggttacccgtaccggttccggtaggtacccgaaccgtacccggtacggtaccccgtcccggttaccccggttacccggttacctaccccggtttcccttaccccgttcccccttcccgttcccg

SEQ ID NO: 201723 - DNA, 831 bp, Homo sapiens
  misc_feature: GYAE6OF01BAZ6L.21.46.E02.1.454.CMB.1.raw
  modified_base (78)..(78): a, c, t, g, unknown or other
  misc_feature (78)..(78): n is a, c, g, or t
  modified_base (137)..(137): a, c, t, g, unknown or other
  misc_feature (137)..(137): n is a, c, g, or t
tcagtcgtcgctcgcacgaccggtgctcgatttagactcatctacagggaaagggggtgggtccaggaggcagaactntggggtgtctcaccatggcctggatccctctacttcctcccctcctcactctctgacanaggctctggacgccttacctatgagctgaccacacgacccacccgtggtgtctaggtccgtaccccaggaccgacggaccggtaccgtaggactaccgacctgaccttcgtgaccgacgtacggttacgaacgtacggaaacctaaaaggtaaatcgttacgttacgtttacgttaaccggtaaaccaagaacgaaccggccgaaccggtaccgaccgggtccgttggttacgtaagtacgtaattaaacgtaacggtaaacggtacaacgtagggaccgtacccggcctaacgtaagaccgttaccgtacgttacggacttacggtaccttccggtacgtacgtccttaccgacgtaccggcggtaacggactacgtacgtaccgtagtacgtactaattaccgagggttaataaccgggtacgaccgtaaacgggacggaacgggtaacggtacggccgtttaacgggtaactaaaccggttatttaccggaaacgttaaaccgggaaactttaaggtaacggggaaacgtttagggaaccgggtttaattacccggggttagttacggggttaaggtccggggtacgggaccggtaaacgggttccggacgggtaccgtacccggttaggtacccggtagaaccccggtacccgtacgggtaccggccccttacccgggtactcccccggg

SEQ ID NO: 201724 - DNA, 895 bp, Homo sapiens
  misc_feature: GYAE6OF01D86GU.21.46.E02.1.454.CMB.1.raw
  modified_base (84)..(84): a, c, t, g, unknown or other
  misc_feature (84)..(84): n is a, c, g, or t
tcagtcgtcgctcgcacgaccggtgctcgatttagactcatctacagggaaagggggtgggtccaggaggcagaactctgggtntctcaccatggcctggatccctctacttcctccccctcctcactctctgccacaggcctctgaggcctacctagtgagtcctagacacgacgccctacccgtggtgtccagtccgtaccccgaggactaacggaaccggccaacgggtacttcccaacccgttgggtacccttccgtagaccggtaatacgttacgggaacctaacgggaacctaaaaaaggtaactttacgtggttaccttttaaggtttaacgggtaaaccaaacgtaaggaaaccacccggaacgggacccgtaaccgggttccccctttagggttagttaggtttaacgaactttaacgttaaaagtaacggttaaccgaacgttacgggaacggtacccgtaccccgttacgaacgtaccgaccgtttacccgtaggaccgtacgttaccgtttcgttccggtaccggtcctacccggtacgttaacccggaggtaaccgggaacgtaggtaccgtaaacgttccgttaaacgggtttctaaacccgttagtaccggtaagggttaccgaacccgggttaacggacggaaccggtaaggggaaaaccgggcggttaccgttacggaaaccttacgtttaacccgttagttaaaccgtaccaaacgtaaggtagaacggttacgtaggtaacccggtttagtacggtacggttagggtccgggtaccgggaaagggtaccgacccggtaacggtgtaccccgggtaacctacgggttaacgaccccggttacgaacccggtaggtcccgttcccgtccccggtaacg

SEQ ID NO: 201725 - DNA, 766 bp, Homo sapiens
  misc_feature: GYAE6OF01AHKO3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggactcacctgctctgcagatggactgaccaaagaaattagtagtcctttagttacggtaaccaacagaacgccaggccaacggcccctaggttacgttagtcgtaattataagtaaagacacctagaggacggtccctacacgtaagactaccgtgaacggcgtagttccttcgtcgggtaccttacccgacgtaccgtcggaacggggaccacgggacgtaaccgtttaccggtacgttacgtaaccgtttacgtaccgaacggttacggtaaacggttacccgaacgggaacgaacggggaacgggttaccggaacgggttactacggttaacctaagttttaaccgtagtaaccctaaagtaacggtaaggtaaccgtaaggttaacggtaacgggttaactttccggaaacgggttttggggttacggttaccggggttaggggtaaaccgggaacccggacggttacccggtaaccggtccggttaaccccggttaaggtacccggttaacccggacccgggtaagcccggttccccgttaccccggtaaccccg

SEQ ID NO: 201726 - DNA, 1075 bp, Homo sapiens
  misc_feature: GYAE6OF01A27F8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggtccctcctatgacgtctgacaccgacgccctacccgtcggtgtctagtccgtaccccgaaggacgacggaccggaccgaggtactccaccgtgccttcgacgacgaggtaacgtcggtaaccgtacgaaaaccgaaaaagtaaacgttagtacgttaacgttttaacggtttaaccggaaaaccgtaaaacgaaacggaaacccggacccgggtaaacccgggtacccggtacccggggtttaccccgttagggggtttacggtttaaggttaacggttaaaagttaaacgttaaaaaccggtaaaaaccggtaaccggtaacggttaacggggaaaccccgggtaacccgggtacccccaaacggggtaaacggtaacccgttaaacccggtccgggtaaaggtacccggggtaaccttttaccgtttacccgggtacggttcccgggtaaccctcccgggtaacggtaaccggttacgggtaaaaccgggaccgtaaacgggtacccgtttaaaggttcccgttaaccgggttaagtaacccgttaacgtttaaccggtaaacggtaccggtaaccgggttaacccgggaaacgggtaaccgggaacggggtaaacccgggtaacggggtacggttaaccgtaaccggtttaaaacgtttaaccgttaaaccggttaaacggtaaaaccgttaaagggaaaacggttaaccggaaaacggttaagggggttaaaccgttacggtttaacgtttagggtttaacggggtttacgggtttaacgggggaccggggtaaaccggggttaaccgggaacggttaccgggttaccgtaaccgggttacccgggaccggttaaccgggacccgtacccggggtaacccgttacccgggttccccgtacccccggttccggttaaccccggg

SEQ ID NO: 201727 - DNA, 938 bp, Homo sapiens
  misc_feature: GYAE6OF01AS7QW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacacgcccacccgtcggtgtcagtcgtccccaggacagacggccaggatacctaccgtgcctcgtgacagagtcggactacgaccgaaagtaatagtagtcttagttacggaccaaacgagaacgccgacggaccacggtcccctaggttacgttaagtgtaacttaagttaataaacggacctacgtaggaacggtaccggtaccctagaacggtaccgtaccgttaccggtaagtaccgtacgttacgtttaccgtccggtacggtcccgttaccgaccggttaccgaacgggtaaccgggaaaccgtacgggttacctaaaccgggtttaccgttaaccgggtttacggaaaccgtttacgtaacccgggttaacggtaaccggggttaaacccggaacccggtaaaggggtaacggaaaccgggtaaaccgggggtaacgggtaacggtaccggtttaaccgttaaacccgttttacggttaaaccttaaccgggtaaaccgttaaaacgtaaccgggttaaccggaacgttaaacggggttaacgggtaaccgttttaaaccggtttcgggttagggttttaaccgggggttacggttaacccggggggtaccgggttaaaaccgggtaaccggttaacgggttaacccggtttaaccccggggtacccggtttaaccgggttaaaccggtaccccggtaaacccgggtaaccccgggtttaaaccggtcccccggggtttaacccccgttcccccggggttaaccccgg

SEQ ID NO: 201728 - DNA, 880 bp, Homo sapiens
  misc_feature: GYAE6OF01APHH4.21.46.E02.1.454.CMB.1.raw
  modified_base (157)..(157): a, c, t, g, unknown or other
  misc_feature (157)..(157): n is a, c, g, or t
tcagtcgtcgctcgcacgaccggtgctcgatttagactcatctacagggaaagggggtgggtccaggaggcagaactctgggtgtctcaccatggcctggatcctctacttctcccctcctcactctctgcacgaggctctgaggcctcctatggancctagaccacacgcccctaccgtcggttctccgtacgtccggtcccccgaaggtacacgggaccggaccgaggtaactcgtacccgttggtccttcgacgggacaaacggtacgttaccgggaaccgttacgaaaacccggaaaaaggtaaaaactttcgtacggtttaaccgtttttagttaaaccgggaaaaccctaaacggtaaacggaaccggacccggaaccgggtacccggaaccgggttcccccggtttaagtttcggttaacggttaggtaaacttaagttaaaacgtaaacgaaccgtaggtacggaacggtaccggtaccctaggtaagaaccgttaccgtacccgtagacgggtccttaacgttaccgtccgtccgtcgtactacggtctaacggacgggacctaacggcggttaaccttcgtaccggtttacgtaccgttaacgttacgtaacggttacggaaccgtaccggtacggtacggaaacgggtacgggtaaccgggtacggttaaccgaccgtttaaccgttagttaaccgttaacgtaacccgtaaaggtacggtaaccggtaagtacgtaagggttacggtaacttgggttacgggtcgggttacggtagccggggtaagacggtacggtcccgttaaggtacccggtcggtaacggacccggacggtacccgaccggttaccgcccggttccccggtacgg

SEQ ID NO: 201729 - DNA, 822 bp, Homo sapiens
  misc_feature: GYAE6OF01DVKY7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtggtgtcagtcgtccccgaggacaggacggccaggactccacctgctctgacagatggactacgaaccgaaaagaaatatcgtatttagttacggtaaaccaacgaagaaccgacccgaacggaccgtaaccgggtccccgttaggttacggtttaaggttaggtaaattaaaacgttaaaacgttaaaaaccggtaaccgtaacggttaacgggaacgggtacccggtaccccgtaacgtaaacggaacgttaccgtacccgttaggacgtaccgttactttaccgtcgtcggtacctccgtaaacgtcgtacggacggacgacgtacgtaacgttccgtaacggttcgtaacttactacgtaacggtacgtaaacgtaccggacggaacgtaagggaacggtacggtacggtacgttaacgtaacgtttacgttaacgtacgttaaaccgtaaaggtaacggtaacgtaaggtaacggttaacggtaacggttaacgttacgggttacgggtttaggggttccgggttacggggaacgggtaacgggaaccgtaacggttacggtaccgggttacccggtacggttacgggaacccgtaccggaacccggtacggtacccgggttccccgtaccccggttacccgg

SEQ ID NO: 201730 - DNA, 761 bp, Homo sapiens
  misc_feature: GYAE6OF01EJ214.21.46.E02.1.454.CMB.1.raw
  modified_base (127)..(127): a, c, t, g, unknown or other
  misc_feature (127)..(127): n is a, c, g, or t
  modified_base (558)..(558): a, c, t, g, unknown or other
  misc_feature (558)..(558): n is a, c, g, or t
  modified_base (568)..(568): a, c, t, g, unknown or other
  misc_feature (568)..(568): n is a, c, g, or t
tcagtcgtcgctcgcacgaccggtgctcgatttagactcatctacagggaagggggtgggtccaggaggcagaactctgggtgtctcaccatggcctggatcctctacttctcccctctcactctcngcacaggtctctgaggtccctactatggactctagacacacgtcccaccgtggtgtcacggtcgtaccccgaggactacggaccggccgtaaggtactccgaaccgttggtaccttcgtacgaccgtaaggtgtaccggactacggaaccaaaagtaattgtacggttatttagttaacggaacctaagacggtaacgccgtaggcctacgtccgttaggtgtacggtatataataacgtaaacgtcgtaacgtacggtaacgccggtccctaaggaacgaatttacccgtaccgtggacgtaccgttacgttccaacggttgccccttaagcggtacggtcgaaacggggtacctaggactaacggttcgttaacgttagaacttctaaaggtcgttaggaccgttacgacgggtaacgaggaaaccggngaccgggttntaaccggttattaacggtctaacggtacaaacggttggaaaccgtaacgtaggggtaactacgtttaggacgtttagggttacggggtcggtaacggccgggtaacggacgttaccgggtacggaacccgttttcggacgtaaccggtcggtaaccggttacccgaaggtccccgtcccgtccccgtaacggg

SEQ ID NO: 201731 - DNA, 724 bp, Homo sapiens
  misc_feature: GYAE6OF01D4IBO.21.46.E02.1.454.CMB.1.raw
  modified_base (595)..(595): a, c, t, g, unknown or other
  misc_feature (595)..(595): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctctatgagctgacacacgcccacccgttggtgtccagtccgtaccccgaggaccgacggaccggccgaaggtactaccaccgtcgcctcgtcggacaggagtacgggactacgaaaccaaaaagtaagtagtcgttacgttttagttaaccggtaaaccaaacgtaacgaaccgaccgacggtccgaaccggtcccgttagttacggttacgtagtaacttaagtaaacgtaaacgactacggtaggaccgaccggtaccctagacgaacgtacctaccgtaggacgtaccgttactttccgtacgtcggtacctacgtacgtccgtaacggacggtacgacgtacgtacgttaccgtacgttacgtactacgtagtaacggtagtaccggacgagtaacgagggacgggtaacgaggtacctacgtaacgttacttacggtaanaaccgtaaagtacgtaataggtaacggtagtaacgttcgttacgtaggggtttccggtacgggtacggacgggtaacgacgtcgacgtccggtacgtacgcgtacgacgacgagtccctccgccgtccg

SEQ ID NO: 201732 - DNA, 760 bp, Homo sapiens
  misc_feature: GYAE6OF01AQHJ1.21.46.E02.1.454.CMB.1.raw
  modified_base (135)..(135): a, c, t, g, unknown or other
  misc_feature (135)..(135): n is a, c, g, or t
  modified_base (163)..(163): a, c, t, g, unknown or other
  misc_feature (163)..(163): n is a, c, g, or t
tcagtcgtcgctcgcacgaccggtgctcgatttagactcatctacagggaaagggggtgggtccaggaggcagaactctgggtgtctcaccatggcctggactccctctacttctcccctctcactctctgcacnggctctgaggcctctatgagctgacacnggcccaccgtcggtgtcaggtcgtccccgaaggacacggaccggcaaggtctaccaccgttgcttcgtgaccaggtagtcggactcgaaccgaaaaagtaacttctgttaaccgttagttacggtaactaacgagaacgcgaacggccaacggtccgtagttacggttataggaacttagtaacgtaacgacgtacgtacgaacggaacggtccgtagaacggacgtaaccgtccgtaggacgtcggttacttactcgttacgccttacgacgtcggtaacgacggacgtacgactacggtcctaggttactaccgtagttaccgtaacggtacggacggttaccccggaaggaccgaaggaacgggacggtacggtacgtaccggtaatttacggttaacgtacgtaaacgtaaccgtagtaaccgtaacggaaggttaccggttaacgggtaacttaggttacgggttacgggttacggggcggttaacggggaccggtaacgtcgggttaccgaaccgggttcccgttacgggttaaaccgtcccgacgtaccccgggtaacgttcccggtccccggttaacccgtttcccggg

SEQ ID NO: 201733 - DNA, 685 bp, Homo sapiens
  misc_feature: GYAE6OF01EER43.21.46.E02.1.454.CMB.1.raw
  modified_base (570)..(570): a, c, t, g, unknown or other
  misc_feature (570)..(570): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctcgtggacggcctcctagtgagctagacacacgccctaccgtggtgtcaggtccgtcccaaggaccgaggaccggccgaggtactccacctcgcctctgacgagtagtcggactacggaaaccaaaagtaatgttcgtacgtttaacgttacgtaaacccgaagaacggaaccgaccggtaacggacccgaaccggtccccgtttagggttacgttaacgtagtaactttaagtaaacgtaaaacggactacggaggaacggtacccgtcccgtagacgacgtaccgtaccgtacgtacgtcgtacgttccgtcgtcgccttacgacgtcgtacggacggacgtagcgtaacgtccgttagttacgacttaacgtcggtaaggtacgtacgtcgaaggacggtacggaacggtagacgtcgtatacgttntacgtagaacgaagagaagagtagtacgattcaggttaggtggtacggcggacggacgagtacgtcgacggaccgtcgtacgacgaccgaccggaccggtcttcccggccgtccg

SEQ ID NO: 201734 - DNA, 839 bp, Homo sapiens
  misc_feature: GYAE6OF01E55GF.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttcctccccctactcactctctcgacacaggcctctaggcggccttcctatcggagtctagaaccacgacgccccgtaacccgttggtacgtcgtaacgtccgtaccccgaggaccacggaccggaccgagggtacctaccgaccgtcggccgttacgtaggacgaacggtacgtcggaaccgttacgaaaccgtaaaagtaaacgttgttacgtacgtttacgtaacgggaaacccaacggtacggaacgtaccgacggtcccgtacggtacccgttggttaacgttacgtactaacgtaacgttaaataaacgccgttaaacgtcgggaaccgaccggttcccaagaacggtaccggttactcccgaaggtacgtaccggttactttcggtaccgtaccgtacccgtaaccgaccggtttcgtaaaccgggaacgaacggtaccccgaaggttacccggttccgttaaaaccgggtttcgtaacgtaaccggttaacgtacggttaaacgggtaccgtaaccgggaccggtaacggacggaacgtcgggtacgacgtaacgtacgtacgttacgtaacgtaacgaaacgtaccgaaggtaccgtaagggtaccgaagtttaccgtaggtagggttcggaccggttcgggaaaccggacgtaccgtcggtaccggtaccgtcgtacgttacgaccgtaccgtacgacccgtcgtccccggtacctaccg

SEQ ID NO: 201735 - DNA, 744 bp, Homo sapiens
  misc_feature: GYAE6OF01D2RB5.21.46.E02.1.454.CMB.1.raw
  modified_base (550)..(550): a, c, t, g, unknown or other
  misc_feature (550)..(550): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctcgtgacggcctcctagtgagcgtacgacacacgccctacccgttcggtcgtcacgtccgtaccccgaggacgacggaccggaccgaaggtactcccaccgtcgtacctcgtagaccgaggtacggtacgaaccgtacgaaacgtaaaagtaattcgttacttacgtttaacgtaaccgtaaaccaagaaccgaccgaccggacgtccgaccgtcgttgttagtacggtagtaaactaagtaaacgtaacgtaacgtcggtaacggaccggaccgtaccgaacgtaacgtaccgtaccgtcgtaggcgtaaccttctccgtacgaccgctacgacgtcgaaggcgacgcgtactacggtactacgtacgtacgttacgacgtatacggacgacgaggacgtaggaacggngacgtacgtaagttactaagtacgacgtaactacggtaacgaagtacggtaacgtagttaacggttacgttggtagggttacggttacgggaacggacggtaccgaaccggtcggttaccgtaaccggtccggacggttacgacccggtaacccggtaccgttacccggtccccgtacccggtcccggtacccg

SEQ ID NO: 201736 - DNA, 743 bp, Homo sapiens
  misc_feature: GYAE6OF01C2YFD.21.46.E02.1.454.CMB.1.raw
  modified_base (83)..(83): a, c, t, g, unknown or other
  misc_feature (83)..(83): n is a, c, g, or t
  modified_base (135)..(135): a, c, t, g, unknown or other
  misc_feature (135)..(135): n is a, c, g, or t
  modified_base (186)..(186): a, c, t, g, unknown or other
  misc_feature (186)..(186): n is a, c, g, or t
tcagtcgtcgctcgcacgaccggtgctcgatttagactcatctacagggaaaggggtgggtccaggaggcagaactctgggtntctcaccatggcctggatccctctacttcctccccctctcacctctctgcanggtctcgtgacgccttcctatggagctagactacgcgccctacccgtggtntacgagttccgacccgaggaccgacgggccggtacaggtacttccaccgttgccttacgtgccgagtgtcgaactacgaaacgaaagtatcgtcgtagttacgtacgaactaacgagtaccgacgacggccgtaccggccttggtcgttagtatacgttaataaaggactacgtacgtagacgtacgtccagagtactacgtccgagcgtccttacgttctacggtcgccgtacacggtccgtacggacggtaccgacgtacgttacgtacgtaccgttcgtaactacgtcgtaaacggtcggaaaacgtccggaacgtaccgggtaagggacgggtacgtacgtaccgttagtaaccgttagtttacccgaacggtaaaaccgtacggttaagaaccggtagtaagggttaaccgtgttaaccgttggttacggttcgggtaaccggtacgggtacgggaacctaaccggggtcttaacccgggcgtttaccccggacggttaacgcccggtaccggtaaccggttcaccccgggttccgttccccgggtaacccg

SEQ ID NO: 201737 - DNA, 762 bp, Homo sapiens
  misc_feature: GYAE6OF01EB8SQ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacagccctacctcggtgtcagtcgtaccccgagacagacggccaggactccacctgcctctagcagactcggacctagaacctaaaagtaaatatcgtactttaagttacggaacctaaacgaacggaacgaccgacggaccgacggtccccgttagttaggttacgtagatttaaagaacgttaaaacgaccgtaacgtagggaacgtaccggtcccttacgacgtacgtacctcccgttagaacgtacgttacttccgtcgtacggacccttaccgtacgccgtaacggaacggggtacctacggtaaccgtacggtacgttacggttacgaacttacgtacggtacggtacgaacggttccgaagaccggtaggaacggaaccgggtgtacgtacgttaactacgtttaacggtacgtaaacgaaacggtaacgtaaggtacgtaacgggtaacgtacggttaccggtacttaaggggttcggttaacgggttcggggaacgtaaccgggaaacggtacgtacggtaccggtacccggttaacggtcgtaaccggccgtaaacccgtaccggtcccttccccggcccgtttacccgg

SEQ ID NO: 201738 - DNA, 642 bp, Homo sapiens
  misc_feature: GYAE6OF01CJ7NF.21.46.E02.1.454.CMB.1.raw
  modified_base (134)..(134): a, c, t, g, unknown or other
  misc_feature (134)..(134): n is a, c, g, or t
  modified_base (264)..(264): a, c, t, g, unknown or other
  misc_feature (264)..(264): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
tcagtcgtcgctcgcacgaccggtgctcgatttagactcatctacagggaaaggggtgggtccaggaggcagaactctgggtgtctcaccatggcctggatccctctacttcctcccctctcactctctgcacnggctctgacggcctctatgagctagacacacgcccaccgtcggtgtcagtccgccccgaggacaggaccggacctaggactccaccgtgtcttcgagacgagtacgtacggacacgaacaaaagtaagtntcgtacttagtacgtaacaaacgagaacgccgaacggcctaacggtccctaggtagtaagtanaagtttaanaagtaagaccagtagagcggccctaagaacgtcaccgtccgtagcgtaaccgtctactcggtcgacctcgtagacccgtaggaacgtactacgcgttaacaacgttgtacgatacgtgagtacgtaacgtacgacggagaagcggagagtcgtaagtactagtactagtaaaccgagtaataacggtagaaggtaagtacgttacgtagttacgggtaacggtcgggtaaggaccggtaaggaccgaacgtggtaacccgccgtacgtacgttaccgacgtaccggactccgccgtacccgggtcc

SEQ ID NO: 201739 - DNA, 797 bp, Homo sapiens
  misc_feature: GYAE6OF01BB75V.21.46.E02.1.454.CMB.1.raw
  modified_base (704)..(704): a, c, t, g, unknown or other
  misc_feature (704)..(704): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctctgcacgaggctcgtgacggcccttcctagtgacgtctgaccacgacgaccctacccggttggtcgtctacgtccgtaccccgaggacgacggtaccggaccgaggtactccgtaccgttgccgttacgtcggactaggtacgtacgggtacctacgaaccgtaaaagtaacttacgtacgttactttacggttacgtaaccgaagaacgtaaccgaccgacgaccggaccggtccgttggttacgttacggtagtaagttaactaaacggtaacgtacgtaacggtacggaacgtccggaacctaggaacgtacgtaccgtaccgtagacgtaccgttactccgtacgtcgcctacgcgtacgacggacgacgtcgactcgtacgtacggtactacgtagtacgacggtagtaacgtacgaggaccgtaaggaccggaggtaccgtactaacgttacgtaacgtagttacgaaacgtaagtacgtaagtaacgtaggttaaccgagtttaagtcgggtttagtaccgggggttacgggtaccgggaagggtaaaccggtacgtaaccggggtntttaacccgggtaccggttaccgttaaccgggaacccgttaaccggacccggggttaaccctcccggtttaccccggggtacccttacccggg

SEQ ID NO: 201740 - DNA, 677 bp, Homo sapiens
  misc_feature: GYAE6OF01B1KWT.21.46.E02.1.454.CMB.1.raw
  modified_base (198)..(198): a, c, t, g, unknown or other
  misc_feature (198)..(198): n is a, c, g, or t
  modified_base (248)..(248): a, c, t, g, unknown or other
  misc_feature (248)..(248): n is a, c, g, or t
  modified_base (427)..(427): a, c, t, g, unknown or other
  misc_feature (427)..(427): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctccactctctgcacaggctctgacggcctcctatgagctgacacagcccaccctggtgtcagtcgtccccaggacnggaccgccaggactcacctgctctggacagtatggactcgacaaagaatntgtactttagtcggtaaccaacaagaacgcgaacggccacggccccttggtagttagtagtactaataaataagacacgtagacggacggtccctacagaacgtctaccgtagacggacctattcctcgtcgtcctacgacgtcgtacggaagggccacgacgtaggtctacggttacncgttacgcgtaaggtacgaacggtcgaagggacaagggaccggtacgaggtacgtacgtaacttacgtactagtaacgaactaggaaggaaccgttgaaggttacggtacctagttcggggttagggttcggtacgggtacggggaaccggtaaccggaacgggttctaccggggtacccgttacgggaaccggttacggaacccggtacccgggttaccggacccgttcccggacccccggtttccggg

SEQ ID NO: 201741 - DNA, 587 bp, Homo sapiens
  misc_feature: GYAE6OF01BFFAU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatccacctgctctgcagatggactgaccaaaagaatatgtcttattggtaaccaacagaacgccgaggccacggcccctgtgttagtgatatataaagacactagagacggcctgagagactccctgacgcgtatctcgtcgctcgacgtcgtcgagggacagcgacgtcgacgttacgactatacgtagtagaacgtccgaggacgaggaggacgagactagtactattacgtacgtaacaacgtagtaacgaagaggtaacgtagtactagttaggttagggtcggtacggtacggggaaggaccgtaacggtcgtacggtcccggtacgtacgggacgtaccggacccgaaggtcccgtcccggtcccccgttacggg

SEQ ID NO: 201742 - DNA, 595 bp, Homo sapiens
  misc_feature: GYAE6OF01A9ZG5.21.46.E02.1.454.CMB.1.raw
  modified_base (272)..(272): a, c, t, g, unknown or other
  misc_feature (272)..(272): n is a, c, g, or t
tcagtcgtcgctcgcacgaccggtgctcgattttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtacccccaggacaggaccggccaggatccacctgctctgcagatggactgaccaaagtaatatgtacttagttacggtaaccaanagaacgaccgacggaccgaccggtccccttgtgttacgtgtaatagtaagtaagacacgtaggacgacggccctagagagactccgtagacgcgtacttccgtcgtcgcctaccgagtccgtacggacgggtacagtactacgtacgtacgttagacgtagtacgtaggtacgtacgcgaggacgaaggaggacgagtcgtacgtacttagtacgtagtacaacgtagacgtagtagtacggtagtacgtgtagttgggtcgtacggacggagtacgacggtcgtacgtccgtacgtagtcgacgaccgagcctccgccgtcg

SEQ ID NO: 201743 - DNA, 922 bp, Homo sapiens
  misc_feature: GYAE6OF01BVDIO.21.46.E02.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcanaggtctctgaggcctctatgagctgacacgacgccctaccgtcggtcgtcgtcgtccgttaccccgaggaccgacgggtaccggaccggaggtaacctccgtaccgtcgtcctaccgtgaccgaggtacgtcgggtaacctaccggaaactaaaaagtaacttagttccgtaacgtttacggttacgaaaaccgaaacggaacggaaccgacccgggaaccggtaccggtacccggtccccgttttaggttacggttaacggtaataatttaaaaccgttaaaacgtaaacgtaccgaagttacgggtaaaccgtccgggaaccctaggaaacggtaaccgtaccgttacccgtaggtaccgaacggtttcttccggtacgttcgggaccctaccggaacgtccgttaacggaaaccggtcgaaacgtccggtaacgttacccgttaacggtttaaccgaacttacggttaacgtaagggtttacccggtaaacgggtcgaaacgggaccgaaagggtaacgggtacggaacggttccgtaacgttaaacgtttaccgttaacggtttaacccgaaacggtaaaaggtacggtacggttaaaacggtacgggttaagggtttaaaccgtttcgggtaacggtttaggggtttacccgggtacggggtaacgggtaaacggccggggtaaaaccgtaccgtacggggttaccccgtttacgggaacccgttaacggaacccggtaccgtaacccgggaataccccgggtcccccgttaaccccggtag

SEQ ID NO: 201744 - DNA, 798 bp, Homo sapiens
  misc_feature: GYAE6OF01D4S7P.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctcccctcctcactctctgcacaggctctgacggcctcctatgagctgacacacgcccacccgtcggtgtcaggtcgtccccgaggacacggacggccgaggatccacctgctctgctaagagtcggtacctacggaccaaaagtaaactagtgtacgtttaacgttacggtaaccaaacgaagaacggaccgaggacccgtaaccggtccccgttaggttaggttacgtaggtaattaagtaaacgtaaacggactaacgtacggacgtacggtccctagacgaacgtctaccgtagacgacgtacttccgtcgtacggtcctacgtacgtccgtacggacgggaccacgtaccgtaacgtaccgtaacggtttcgtaacttacgtacgtaaagggtcggtaaacggttaccgaacgggacgtaaacgggaaccgggtagggtacggtacgttaacgggtaaactttaacgtttaacggttacgtaaaccgtaaacggttaagggtaccgtaaacggttaaggtaacgggttaaccggttacttaacgggtacgggttttaggggtcccgggtaggggtacgggaaaccgggtacgtaccggtacggtacccggtaccgttaccgggtaggaccctaaccgggtaaccggtaacccgggtccctccccgggtccccgttacccggg

SEQ ID NO: 201745 - DNA, 681 bp, Homo sapiens
  misc_feature: GYAE6OF01EE1WJ.21.46.E02.1.454.CMB.1.raw
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacacgcccacccgttcggtgtcacgtccgtccccaaggacaggaccggccaggactccactgctcngcagagtcggactgaccaaaagtaattntgtactttagttacggtaaccaaacgaacgaacgccgaacggccgacggtccccgttaggttacgttagtagtacttaagttaaagtaaaacgtacgaacgttacggaacggtaccggaccctacgaacgacggtacctccgtaggacgtcgttacgttccgtcgtcgacctcgacgtccgtacggacggacagacgtacgtacgtacgttacgtaacttagtaccgtagtacggacttacggaaggacgtagggaacggacgtacggtctaacgtaactttacgttaacgtacgtaacaagtaacgtaacgtaagtaaggttacgtaacggttcgttacgtagggttcgggtacggtcgggacgggtaacgacgtacgcgtacggtaccgtacgtagccgaacgtccgacgtctcccgtcccgtcg

SEQ ID NO: 201746 - DNA, 655 bp, Homo sapiens
  misc_feature: GYAE6OF01CPS1V.21.46.E02.1.454.CMB.1.raw
  modified_base (537)..(537): a, c, t, g, unknown or other
  misc_feature (537)..(537): n is a, c, g, or t
  modified_base (628)..(628): a, c, t, g, unknown or other
  misc_feature (628)..(628): n is a, c, g, or t
tcagtcgtcgctcgcacgaccggtgctcgatttagactcatctacagggaaaggggtggtccaggaggcagaactctgggtgtctcaccatggcctggatccctctacttctcccctcctcactctctgcacagctctgagcctctatgagctagacacacgcccacccgtggtacgtcagttcgtaccccgaggacgacgacggccaggacttccacctgcctcgtcgtacaacggtgtacgtactacgaacctaaaagtaaacttgtagttcgtttaagtaccggtaacaacgagaacgtccgacggtccgaccgtcccttgttacgtatagtaagttaactaacgtaacgacgtacgtgaacggacctacctaggactacgtacctccgtagacggtcttacgttccgtcgacgtccctacgcgtcgtacgaacgctacgccgttagtacctcggtatacgtacgttagtaggtactccggtacgaggactaagggacgtcgagtctaacgtctagtactagaaacgattaganagtacgtgaattccgtaaggttaggttcgggtacggtacggacggtaaccgtgaccctgttaaccgcccgttacgtaacgcgaccccgtanccggtcccgtccgttcccgtaacccgg

SEQ ID NO: 201747 - DNA, 858 bp, Homo sapiens
  misc_feature: GYAE6OF01BXWP2.21.46.E02.1.454.CMB.1.raw
  modified_base (132)..(132): a, c, t, g, unknown or other
  misc_feature (132)..(132): n is a, c, g, or t
  modified_base (182)..(182): a, c, t, g, unknown or other
  misc_feature (182)..(182): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctcngcacgaggctcgtggacggtcctcctagtcggacgtctagaccacgaccnccccgtaccgtcgggtcgtccgtacggttcccgacccgaggacgacggaccggacgagctccgtacctgcctgtcgacgagtagtacgacgtacgaacgtaaaagtaactgttagttacgtttacgtaacggaacaacggaacgaaccgccgaccggtccggaccggttaccgtggtaggttagtagtaaataagtaaacgaacgacgtagtacggaacgaccgttaccgagtacgtaccgtaccgtcgtaacggtcttacgttacgttcctaaggtcccggttacctcggaacgtaccgggtaacggaacggtcggtaacgaccggttagtacgtttacggacttaacgtaccgaaggttacgaacggtaaccgggaggaccggtaacgggtaacgggaggtaccgggtcgttaacgtaaccgtttaacgtacggtttaaacaacggtaaaccgaaagttaaacggtaacggttaagggtaacggttacgggttaaaggtttacgtaaccggggtttagggttaaccggggtggttaacccggggggtaaacggtaacccgggttaacgggtccgttaacccgtacccggggtttaaccctacggggtaacccgtaacccggttacccggaaccggttacccgcccgggtttacccccggcccgggtttaacccg

SEQ ID NO: 201748 - DNA, 1037 bp, Homo sapiens
  misc_feature: GYAE6OF01DSZB3.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctcccctcctcactctctgcacaggctctggacggcctcctagtgacgtcgtacgacacacgccctacccgtcggtcgtccgtacggttccgtacccccgaagggaccgaacggacccgggccgaagggtaccttacccgaaccgtcgtccttcgtacggacgaaggtacggtacggaccgtacggaaaccgtaaaaagtaaacgttcgtacgttaacgttttaacggttaaccggtaaacccgaaaacggtaacggtaaacccggaccggtaacccgggacccgttacccggggtacccccgtttggggtttaaccggttttaaggtaacggttaaaactttaaacgttaaaacgttaaaaaaccggacccgttaaaggtttaccggggaaaaccgggttaccccgggttaacccccgttaaaggaaacgggttaaacccggtacccttaaccccgggtagggtaaacccggtttccgggtttaaaccttttccccggtaaccggtttccgggtaaccccgttacccggtaaccggtacccggttaaccggggaacgggtaaaccacccgggttaaccgttaccggttaaccggtttacgttaaccgttaaccgttacgtaccggtaaggttaaccgggaacccgttaacggacggacggtaaggggaccgggtacgtacggttaacctaggtttaaaccgttacgtttaacccgaaggtaaaccgaaacgggtcctaaacgggtataacggggtaacgtacgttaacgtgggttacggttaccggggttcgggtaccgggaaccgggttaaacggaacccgtgggttaccggttacccggtaccgggtttacgaaaccgggttccgaaacccgggttaaccccgtacgggttccccgttacccccgggcccggtttacccg

SEQ ID NO: 201749 - DNA, 769 bp, Homo sapiens
  misc_feature: GYAE6OF01CWBT4.21.46.E02.1.454.CMB.1.raw
  modified_base (162)..(162): a, c, t, g, unknown or other
  misc_feature (162)..(162): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (543)..(543): a, c, t, g, unknown or other
  misc_feature (543)..(543): n is a, c, g, or t
tcagtcgtcgctcgcacgaccggtgctcgatttagactcatctacaggggaaagggggtgggtccaggaggcagaactctgggtgtctcaccatggcctggactccctctacttcctcccctctcactctctgcacgaggctctcgacggtcccttacctanggacgctagacaccgtacgcccctacccgtcggtgtacgacggttcccgtacccgaggaccacggaccggaccgtaaggacctccgtaaccgtcgtcctccgtacggactaggtagtacggaccgtaagaaaaccgtaaaaaggtaaattacgtacgttaacgttttaacggttaccgaaaacccgaaagacggaaaccgccggtaaccggccgtaaccccgggttccgttagtttagtacggttaataagtaaattaaacgacgaacctggtaacggtaacgaccggtacctaaggaactaccgtctaccggtagacgtcttacgttccncggttacnctacgngtaccgagaggtaccagtctacgtacgtcggttaanactagtacggtagtaccgaacgtacggagtaacggaggtaggtacggtagtaccttaacgtacttaacgtacgtaacgtacggaaacgttagaacgtaacggtaacggtagttacgttacgtaggttagggttacgggtacggtacggaccggtacgtacgggacttaccgacggttcctaggacccgtacgccggaaccgtccgtaccgcccgttcccggtaacg

SEQ ID NO: 201750 - DNA, 771 bp, Homo sapiens
  misc_feature: GYAE6OF01C6DI1.21.46.E02.1.454.CMB.1.raw
  modified_base (107)..(107): a, c, t, g, unknown or other
  misc_feature (107)..(107): n is a, c, g, or t
  modified_base (160)..(160): a, c, t, g, unknown or other
  misc_feature (160)..(160): n is a, c, g, or t
  modified_base (183)..(183): a, c, t, g, unknown or other
  misc_feature (183)..(183): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (391)..(391): a, c, t, g, unknown or other
  misc_feature (391)..(391): n is a, c, g, or t
tcagtcgtcgctcgcacgaccggtgctcgatttagactcatctacagggaaagggggtggtccaggaggcagaactctgggtgtctcaccatggcctggactccctntacttcctcccctcctcacctctctgcacgaggctcgtgacgtcctctatganctgacacgacgccacccgtggtntacgagtcgacccgagacagacggacagactcacgtnctcgtagacagancggacagaaaccaaagaatgtacgtntttaacgtaccgaaaccaagagtaaccgacgtacgaccgtacggtaccgttagtaggttagacgtaataagaaaacgtaacgtaccaaggtaacggcgtacgtaccagtaaacggactccgtaacctaaggngtaaccgtttcgttactcgggtacctctaccggtagtaccgtaacggacccggagtaaacggcgtaaaccgttaccgtaaagtcccgtaagttaacgtacgtacgtaacggaacgtacgaggacgaaggacggaacgtacgtagttaactagttacgttaacgtaacgtaagtaaacgtaaggaacgtaaacggtagtaacgttaacggttaccgttaggttacgggttgggtttaaccggggttaacgggtacgggtaaacgggaacccggtaaacgggttacccgttaaccgggtacccggtaacccgggtttacggaacccgttaaccggtacccggtaaaccggtccccggttaccccggtccccggtttaccccg

SEQ ID NO: 201751 - DNA, 841 bp, Homo sapiens
  misc_feature: GYAE6OF01BJQMD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccacccgtcggtgtcagtcgtccccaggacaggacggccaggatcacctgctctgcagatggactgaccaaagaatatgacttagttacggtaaccaaacgaacgaacgccgacggccgacggccccttggttgttagtgtaattaataataaacgacacgtaggacggacggtccctagaagacgacgtccccgtaggaaccgtcggtaactttccgtcgttacggggcccttacccgacggtacccttaccggaacggggaaccgacgaacgtacggttaccgtacggtttacgtaacctttaataccgtaagggttacggtaacgttaccggacgggacgtaacgggacgggtaacgggacggaccgttaacgtaacgttaacgtttaacgtaccggttaaacgtaaacgtaacggttaacgaacggttaaggttaaccgggttaaaggtttaacccgtacgggtttaagggttttccggggggttacgggtttaacccggggggtacgggggtaaacccggggttaaacccggtaacgggttaccccggttaacggggtaaccccccgtttacccggggttaaacgggtacccccggtaaaacccggggaccccgttaaacccgggtaccccccgggttcccccggtcccccccccgggttaaccccgggg

SEQ ID NO: 201752 - DNA, 910 bp, Homo sapiens
  misc_feature: GYAE6OF01EGL79.21.46.E02.1.454.CMB.1.raw
  modified_base (191)..(191): a, c, t, g, unknown or other
  misc_feature (191)..(191): n is a, c, g, or t
  modified_base (557)..(557): a, c, t, g, unknown or other
  misc_feature (557)..(557): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctcactctctgacacaggctctggacgtccctctagtgagctagaccacgtacgcccaccgttcggtntcacgtcgtacccgaggaccacggtaccggccaggactccacgtcgtcctcgtacgactaggagtccggactacgaaaccgtaaaagtaaattcgttcgttaacgtttacgttaacggaaccaaagaacgtaacgcccggacggacccgaccggttcccgttagttacgttaaggtacgtaagttaacgttaaacgtaaacgtaccgtaggtaacgggtaacggaccccggtaccgtacgtaaacggtacgtaccccgtaccggtaggtaccgtaccgtttaaccgttccgttacccgggtcggtaaccctacgtacggtaaccgtacccgggaagggacccgtacgggtacctaaacccgggttnttaacccgggtttacgtaacgttaacgttacgggtaacgtaacggtaaccgtacgggtaacggacgggtaacggaacgggtaccgacggttcgttaaccgtttaacttaccggttaacgttaaccgaaccgtaaacgaacgggtttaacgaaacgggtacggtttaaagtttacccgttaagggttaccttagggggttttcggggtaaccggtttacggggaaaccgggtaaacccgtaagggttacccggttcggtttaaacccgggccccgtttacgggaaacccgggttacccgacccggtaaacccggtccggttaccccggttccccggacccgggtttaacccccg

SEQ ID NO: 201753 - DNA, 637 bp, Homo sapiens
  misc_feature: GYAE6OF01AYG4U.21.46.E02.1.454.CMB.1.raw
  modified_base (259)..(259): a, c, t, g, unknown or other
  misc_feature (259)..(259): n is a, c, g, or t
  modified_base (395)..(395): a, c, t, g, unknown or other
  misc_feature (395)..(395): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaaagaatatgcttattggtaaccaanagaagccaggccaggcccctgtgttagtgataatataaagacactgacgacggacctcgaagacgacttcccgtaggacgtcgtaatttcgtcgtcggctaccagccgtacggacgggacaggcacgtcgaggttnacgttataccgagtaggaacgttccgaaggtacgaaggagggacgaggtactaggtaactacttacgtacgtaaccgaaacgtagtaacgaacgtaggtaaggtacggttacttggtaaggttcgggttcgggttacgggaccgggtaagggaacccgtaagggtccgtacgggtacccgttcggtaaccggttaccaacgggacccgtaacggcccgttaccccgggtcccccgttaccgg

SEQ ID NO: 201754 - DNA, 827 bp, Homo sapiens
  misc_feature: GYAE6OF01BVK88.21.46.E02.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacngctctgagcctctatgagctagacacacgcccaccgtcggtgtcagtcgtcccgaggacagaccggccaggactccacctgtccttgtcgacagtagtcggtactacgaaccgaaaagtaatagttcgtactttagttacggtaaccaacggacgaacgccgtaacggaccgtaaccggttccccgtaggtttacggttagtagtaaattaaagttaaacgtaaaacgaccgtaacggtaggaacggtaacccgggtacccttaacgaaacgtacgtaaccttccggaaggtacgtaccttaactttcccgtcggtacgtcccgtacgtaccggtaccgtaacggaaccgggtacgtaacgccgttaaccggtaccgttaacggttaccgtaacgttacgtacgtagtaaccggtacgtaccggaaggtacggaaacgggtacgggaaccggtacgtaccgtacgtttaacgttaactttaccgtaagtaacctaaggtaacgtaacggtaacgttaacgggtacgttaacggttacgtacggttacgggtttacgggtcgggttaaccgggacgggtaaccgggaacgttaccggtaccggttaccggtaccccggttaccggttaacggtaacccgtaacccgggacccggttaacccggcccgtttcccccggtccccccgggttaacgg

SEQ ID NO: 201755 - DNA, 993 bp, Homo sapiens
  misc_feature: GYAE6OF01BO3Z1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctccactctctgcacacggctctggacggtccgtcctaatgagcctgacacgacgcccctaacccgttcggtgtccagttccgtacccgaaggacgacggtaaccggacctaaggtacttaccgaaccgtcggaccttaccgtacgacgaacgagtacgggtaaccgttaccggaaaccgaaaaaggtaaatacgttacgtactttaaccggttaacggtaaacccgaaaccggtaaaggaacccgaccggtaaaccggtacccggtaaccgggtacccccttaagggtttaacgtttaacggttaagtaaccgtttaaaagttaacgttaaaacggaaacgtaaccgttaggaaaccgggaaccggtaacccctacggtaaacggaccttaaccgttaccccggtaacggaccggtaaccgtttactttaccccgtacggtttccggtaacccaccggtaaccgtccgtaacgggaacgggttaaaccgacggtaacctaacccgggttaaccgtaaccggtttaacaaccgtttacgtaaccggttacgtaaacggtaaaccggtacccgtaaaggtaacgggtaaacgggttaccgggaaccgggtaccgggtaaacggttaccttaaaaccggtttaattaaccggaacgttaaacccaaaggtaaacgttaacgaaccgtaagggtaaacgtacgggttaacctacgggttaaacgggttcgggtttaaaccgggaccggggttaacgggtaaccggtaacccggtaaggttaccccgggttaaccggttaacccggtaaccggttaaccggaacccgacgttaacccggaccgggttacccgttaccggtacccccggttacccg

SEQ ID NO: 201756 - DNA, 867 bp, Homo sapiens
  misc_feature: GYAE6OF01APFI7.21.46.E02.1.454.CMB.1.raw
tcagtcgtcgctcgcacgaccggtgctcgatttagactcatctacagggaaagggggtgggtccaggaggcagaactctgggtgtctcaccattgcctggactccctctacttcctcccctcctcactctctgcacgcggtcttcgtcggacgtccttaccgtagtacgagctacgaccacgaccgcccctccgtcggttcgtcgtacggtccgtacccgaggacggacggtaccggacgaagtacctaccaccgtggtccttgacggaacgtaggtacgttccggaacgtaacgaaaacctaaaagtaagttacgttacgtttacgtttacgttaaccgaaaccaaacggaacgtaacggaccgaccggaccgtacccggtccgtggttacggttagtagttaataacgttaaagaacgacacggttacggaccggaccgtacctaagacggtacgttacctcggcgtacgtcctttacgtccgtacttcggtccctacggacgttcgtaacggacggaacgtcgtaacgtacgttaccggtaggtacttacgaacgtaggtaacgggtaacgtaaccgggtacggaaccggtaacgggacggtaaaccgggaacgtaccggttcgtaacgttaacggtttaaccgttaacggtaaccctaaaagggaacgttacggtaaactaaacggtaacgggtaacgttacggttaacgtttaggggttaggggttacgggttccggggtaacggggtaaaccgggaccgggtaaccgtaacgggtacccggttaaccggttcggtacccggtaacgtacccgggtaaccgacccggttacccggtaccccgttcccggaccccgttaccgg

SEQ ID NO: 201757 - DNA, 718 bp, Homo sapiens
  misc_feature: GYAE6OF01D1FK9.21.46.E02.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagactcatctacagggaaagggggtgggtccaggaggcagaactctgggtgtctcaccatggcctggatccctcgtacttctcccctctcactctctgcagagctactgacggccttccgtatcgagtcagacacagccctacccgtggtgtcagtcgtcccaggacaggacgcaggatcgactgcttcngacacgtataggactacgaacaaaagtaaactgtcgttattaagttacgtaaaccaaagaacgaacgacccgaaggaccgtaacggacccctttggtacgtttagtagtaataacgtaacgtaaacgacacgtaggacacggtcctagagtacgactaccgtagtagacgtacttcgtacgtacgtcgccgtagccgtaccggaagtaccgtacggtaactacggtaccgttaggttaacgaacgttataccggtaagtacggtaacgtaaccggtaggacggaggtaacggtacgaacggtctaacgttactaagtttacctaagttaacgaacgtaagtaacggtacgtaagtaccgggtaagtacgttacgtaggtttacgggtacgggttacggaccgggtaaaggaccggtaacgtacgtacccgttaaacggtcgtaacccggttagaacccggtacgtaaccggcccgttacccgaccccggttacgg

SEQ ID NO: 201758 - DNA, 677 bp, Homo sapiens
  misc_feature: GYAE6OF01BN0UY.21.46.E02.1.454.CMB.1.raw
  modified_base (281)..(281): a, c, t, g, unknown or other
  misc_feature (281)..(281): n is a, c, g, or t
  modified_base (429)..(429): a, c, t, g, unknown or other
  misc_feature (429)..(429): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccacccgtggttgtcagtcgtccccaggacaggaccggccgaggactccaccgtgcctctgacagtacgtggacctcgaacaaaagtaatatgtacttagttacgtaaccaanaagaacgaccgacgaccgacggtccccgtagtgttagtagtaattaagtaataacgacctagtaggaaggaccggtaccctagaaggtactactcccgagacgtcgtactttccgtcgtcggtcctcgtacgcgtacggaacggaacngactaaccgtcgtacgttacgtacgtactcgtaagtacgtacgaccgtagggacaagggacgacggagtcgtagtacttagtactacgaacaacgtagtaacgacgtaagtacgtacgttactggttaggtcgggttacggtacgggacggtaacggtaccggtaagttccggtaaccggtcccggttaacgtacccgggacgaccgtacccgggtaacgccccgttccccgggtcccgttaacccgg

SEQ ID NO: 201759 - DNA, 699 bp, Homo sapiens
  misc_feature: GYAE6OF01BA3TO.21.46.E02.1.454.CMB.1.raw
  modified_base (258)..(258): a, c, t, g, unknown or other
  misc_feature (258)..(258): n is a, c, g, or t
  modified_base (413)..(413): a, c, t, g, unknown or other
  misc_feature (413)..(413): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagtctgacacagcccacccgttcggtgtccagtcgtccccaaggacaggaccggccaaggactccacctgctctgcagactggactcgaacaaaagaaacttntacgactttattacggaacctaaagagaacgaccgaacggccgacggccccttggtacggtttaagacgtaattaagtaaataaaacgaccgaacgttaggaacggtaccggtaccctacgaagaacgtactcccgtagaccgacgtacgtttcncggtcggtcctaccgcgtaccgtacggaggtaccgaaggaccgtacgtacgtacgttagtaactgtaacctaggtagaaccgttacgaggaacgtacggaaggtacggaggtactacgtaacttaacgttacgtaagtaaccgaaagtaacggtaaccagtaagggtacgtaagttaaccgtgttacggttagggtcggtttaccgggacgggtaaccgaacgtacgtcgtacggtaccgtacgtaccgcgaaccggacccgaacgtcgtcccggtccccgtaccg

SEQ ID NO: 201760 - DNA, 858 bp, Homo sapiens
  misc_feature: GYAE6OF01C83WC.21.46.E02.1.454.CMB.1.raw
  modified_base (83)..(83): a, c, t, g, unknown or other
  misc_feature (83)..(83): n is a, c, g, or t
tcagtcgtcgctcgcacgaccggtgctcgatttagactcatctacagggaaaggggtgggtccaggaggcagaactctgggtntctcaccatggcctggatccctctacttcctcccctctcactctctgcacgtacggtcttcgtgacggtccctctagtgtagctagacaccacgccctacccgttcgggtctcgtacggtccgtacccccagggaaccgacggacccgggccaaggactcccgtaccgtcgccttccgtgaccgaaggtacgtcgggacctacgtaaaccgaaaaggtaaacttgttacgtacttttaacgttacgggtaaaccaaacgtaaggaaccgtaccgacggacccgtaccgggtccccgtttaggttacgttaggtactaactaaagttaaacgtaacgacgtacgtaacggacggtacgtccctagaacgtacgtacctaccggtaggacgtacgttcttccgtacgttacggccctaggacgtccggaggacggtacaggtaccgtacgtacgtacgttacgacttagacgtagtacgacgtaccggagacgtaaggcgttaacggagtacgtacgtaaacgttacgttaccgtaacgttaaacgaacggttaaaggaaccgtaaaacggtagggttaacgggtacgttaccgtttacggttaacgggtttagggggttacccggtttaacgggggaacgggttaaaccggggaaccggtttacggaacccgggttttacgggtaaacccccggttaccgggttaagtaacccccgggtacggaacccgggttacccggttaaccccggtccccgtttaaccccggggtaaccccg

SEQ ID NO: 201761 - DNA, 925 bp, Homo sapiens
  misc_feature: GYAE6OF01D8NLA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacgacggctctggacggtccctcctagtgagtcgtagaacaccacggcccctacccgttcgggtgtcctagtccgtccccgaagggacctacgggaccggcccgaaggtactacccgtaccgtcgtccttaccgtacggacaacggttaggttacgggaaccgttacgaaaccgtaaaaaaggttaaaacgttcgttaccgttagtttttaacggttaaccggttaaaacccgaaaccgaaacgggtaaccggacccgggaacggaacccggtaccggttacccccgtttggtttaaccgggtttaggttagtaagttaacgttaaagttaaaacgaaccgttaacgggtacggaaacgggtcccggtaccgtttaaccggaaacgacgtacccggtttccgacgggtacgacggtttaacgtttcccgttcggtaaccgcccgttaaccgtacgtaacccgggtacggaaccgggggactaacggtaccgttacggtccggtttaacggtttaacttacgttaacgttaccgggtaaggtacggtaaccggtaccgggagggtaaccgaagggggaccgtacgggtagtaccgtaccgtttagttaacgttcgtaacaacgtaagtaacggtagtaaggtacggtaaggttacgttacgtagtttacggttcggggtcggttacgggaccggtaaacggtcggtaaccggtacgtacccggttacggtaccggtaacggaaccggacccggacggttaaccccggccgtaacccccggtccgttaacccgg

SEQ ID NO: 201762 - DNA, 829 bp, Homo sapiens
  misc_feature: GYAE6OF01B3H1Q.21.46.E02.1.454.CMB.1.raw
tcagtcgtcgctcgcacgaccggtgctcgatttagactcatctacagggaaagggggtgggtccaggaggcagaactctgggtgtctcaccatggccggatcctctacttctccctctcactctctgcacaggctctgacggccttctagtgacgcgtgacacgacgccaccgttcggtcgtacacgtccgtacccgaaggacacggaccggaccgaaggactaccgtactcgtccgtactcggacaaggtacgtacggtactacgaaaccgaaaagtaagtacgttctacgtttacgttaaccggaaaccaaacgaacggaaccgaccgacgggacccgtaaccggttcccgtttaggttaggtttaacgtaagttaacgttaaacgtaaaacgttaaacggtacgtaacggtacgggaaacggtaccgggtaccctaacggacgtaacgtaccgttccgaggtaacgttcgttaactttcgtacgttcggtaccgacgtacggtccgtaggaacgggacgacgacgtacgttaccggtaacgttaactaacgtactacggtacggtaacggacgtaacggacggtaaggacggacggtacggacgtagttacgtaactttaacgtaccgtaacgtaacgaaagttacggaacgtaacggtacggtaacggtactttaacggtcggtttagggtttacgggttaacgggtaccgggtacgggtaaccgggaaccgttacggtaccggttaccgttaaccgggttcgtaaccgggtaccgaaccgggaccgttaccgggaccgttacccgggttcccggttgtaccccg

SEQ ID NO: 201763 - DNA, 885 bp, Homo sapiens
  misc_feature: GYAE6OF01BB6D7.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctcccctcctcactctctgcacaggctctgaggtcctcctatgagctagacacacgccacccgtcggtgtcagtcgtcccgaggacagacggaccaggactccgacctcgctcgtcgcgtagtagtcggtactacgaaccgaaaagtaaaatacgttagtacttttaacggtttaccgggaaaccctaaaacggtaagggtaaaaccgcccggaacgggtaacccgtacccgggtacccccgtttaggtttacggtttaacggttagtaaattaaacgttaaaaggttaaaaccggtactaacggttacggaacggtacccggtaccctaacggtaacggtaacgtacccttaaccggaggtaaccggaccgttactttccgttaccgtcggtcccgtacgacgtccgtaacggaaggacctagtacggtaccgtcgttaacggttacgtaactacgtacgtaggtaacgacgtaacccggagggaacgaacgggtaacgggacgcggtacgttaactaacgttagttaccgtaacgtaaacgaaacgttaaggaaccggtaaggtaacgttacgggggtaccttaacgttacgggtttagggtttacccgggtcggtttaaccgggggaacggttaaaccgggggtacgtaaaccggggtttccctaaaccgggggtccccgtttaaccgggtaccggttaccccggaaaccgggtaccccgtaaacccggggttacccccttaacccccgggttcccccgggtttaaacccg

SEQ ID NO: 201764 - DNA, 783 bp, Homo sapiens
  misc_feature: GYAE6OF01AV7Y7.21.46.E02.1.454.CMB.1.raw
  modified_base (254)..(254): a, c, t, g, unknown or other
  misc_feature (254)..(254): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtgtcagtcgtccccaggacaggacggccaggatccacctgcctctgcagagtcggactaggaccaaaagtaaatntgtacttagttacggtaaccaaacgagtaacgccgaacggccacgggtccccttggttacggttaaggtagtaacttaattaaacgtaaaaggtacctaacgttagggaacggtaccggtaccccttagaacggtaacgtaccttccccgtaggaaccgtcggttaactttccgtcgtacgggtcccctaccgtacggtccgtaccggaacgggtaccgaacgtccgtaacgggttacctaaccggtttacgaacttacgtacggttaacgggttacggaaccggttacccggaaagggtacgaagggtaacgggaccgggtaggtccgttaacggtacctttaagttaccggtagtaaccaaacggtagtaaccgaaacgtaagggttaacgggtaacgttacccgttaggttagggttacgggttgggttaccgggacgggaaccgggtacacggtaccggtacggtacccggttacgtaacggtaccgacggtaccgtaccggccgtcccggtccccgttaaccgg

SEQ ID NO: 201765 - DNA, 702 bp, Homo sapiens
  misc_feature: GYAE6OF01BLAVZ.21.46.E02.1.454.CMB.1.raw
  modified_base (244)..(244): a, c, t, g, unknown or other
  misc_feature (244)..(244): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacgaggctctggacggtcctcctagtgagctagacacacgcccacccgttcggtcgtcacggttccgtaccccgaagggacacggaccggccgaggactccactcgctcngacgagagtacggactacgaacgaaagtaatagtatactttagtacgtaaccgaaagaacgaacgaccgacggaccgaccggtccgttaggttacggttagtagaattaaagttaacgtaaacgactagtaggaacgacggaccgtanagacgtcctaccggngacgtcgttacttcgacgtccgccgtacggacctcgacggacggtacgacgtactacgtcgtacgttacacgttagtacgagtaacgaacgtacggaagacgaagggacggacgtcggtaacgtacgtaacgttactacggtaactaacgaagttaacggaactaaggtaagtaacggttagttaccgttaggttcgggtagggttacgggtacgggacggtaacgggttacgagttccggtaaccggtcgtaacggtcgacgaccggacgaccgttccgcccgtccggtacccg

SEQ ID NO: 201766 - DNA, 786 bp, Homo sapiens
  misc_feature: GYAE6OF01AF45U.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggccctcctatgagcctgacacacgcccacccgtcggtgtcagtccgtcccgaggacgaggaccggccgaggactccgaccgtcgctctgacgagatcggactcgaaccgaaaagtaaattagtacgttacgttttaaggtttaccggtaaacccgaaaaccgaaaggaaaccgacccgggaacgggaccccgaaccgggttccccccgttaggtttaccggttagttaaggtaactttaacgttaaagaaaacgtacgaaccgttagggaacggacccgtacccgtacgaacggacgttacccgtaccggtagaacggttccgtacgtttaccgtccgtacgggtcctacccgaggtccgtaacggaccgggaccgtacgtaccgtaccgtcgtacgttacggtacttacggtacgtaggtaccgtaacgtaccggacggacggacggaggtacggaggtacgtacgtacttaacttacggtaactaacgaacgttaacggtaagtacgaagtacgtaacgttcgttaggtaggttcgggtacggtacgggaccgggagaccggtacggtccgtaccggtccgaccggttacgaccggtacccgtacgtaccccggcgtccccggtccccggttaccgg

SEQ ID NO: 201767 - DNA, 874 bp, Homo sapiens
  misc_feature: GYAE6OF01ARY8S.21.46.E02.1.454.CMB.1.raw
  modified_base (620)..(620): a, c, t, g, unknown or other
  misc_feature (620)..(620): n is a, c, g, or t
  modified_base (849)..(849): a, c, t, g, unknown or other
  misc_feature (849)..(849): n is a, c, g, or t
tcagtcgtcgctcgcacgaccggtgctcgatttagactcatctacaggggaaagggggtggtccaggaggcagaactctgggtgtctcaccatcggcctggatccctctacttcctcccctcctcactctctgcacaggctctgacggcctcctatgagctagacacacgccctacccgttggtgtctaggttccgtaccccgaaggacacggaccggccaacggactcctaccgtgcctcgtcggacaaggtactcggaacctcgaaacctaaaaggttaaattacgtcgttacgtttaacgttacgggtaaaccaaaggacgaaaccgcccgacggaccgtaccggtaccccgttggttaggttacgtagtaactttaagtaaacgtaaaacgaccgtaacggtacggaaacgggtaccggtacccttacggaacgttaacgttaccccgttccggtaagggtaccgtccggttaaccgtttcccgttacggtaccggtacccgttaccgcccggtacggtaaccggaacgggaccacggtacgtacgtaccgttacggtaccgtaatacggtacgtaacggtacggaccgtacgaacggggtacgaacgggaacggngggtaacgtaccgttagttaactaacgttacggtaacgtaacgtaagtaacgaacggtaggtaacgtaacggttacgtaacggttagttacggggtttacgggttcggggaacccgggtaaaccggggaccgggttaaaccgacgggtttaccccggtaacgggtcccccggtttaagggtacgggttaccccggaaaccgggttaccccggaccggggttttaccccnccccggggtttcccccgttaacggg

SEQ ID NO: 201768 - DNA, 839 bp, Homo sapiens
  misc_feature: GYAE6OF01C8TJB.21.46.E02.1.454.CMB.1.raw
  modified_base (135)..(135): a, c, t, g, unknown or other
  misc_feature (135)..(135): n is a, c, g, or t
  modified_base (185)..(185): a, c, t, g, unknown or other
  misc_feature (185)..(185): n is a, c, g, or t
  modified_base (233)..(233): a, c, t, g, unknown or other
  misc_feature (233)..(233): n is a, c, g, or t
tcagtcgtcgctcgcacgaccggtgctcgatttagactcatctacagggaaagggggtggtccaggaggcagaactctgggtgtctcaccatggcctggatccctctacttcctccccctctcacctctctgcanacggctcgtgacgccctctatgagctagacacgacgccctacccgtggtntacgacgtccgtacccgaggaccacggaccggacaggactccaccgtnaccgttctgacaggtgtacggactacgaacaaaagtaatgtacgttactttacgttacggtaaaccaacgaagaaccgacgaccgggccgtaccggtacccttaggttacggttagtacgtaaacttaagtaaacgtaaacgaactacggtaagacggtaccgtacccgtacgaacggtaactacccgtaccggtaacggacgtaccgtttactttccggttacgtccgtaccgtaccgtacgtaccggtacggaacggacgtaacgtcgtaacgttaccgttacgtaacgtacgtaacgtacgtaacggtacgtaaccggtaaccgggacggtaaacggaacgggaacgggaccgggtacgtacccgttaaggttaacccgttttaagtttacccggtaaacggttaacgtaaaacgtaagggtttaaccgaacggtttaagggtacggtaagttttaacccggtaggtttagggttccggggtttaaccgggaccggggtagggtaaccggtacggtaaacggtcccggttaccggtaccggttaaccgtacgacccggttacggaacccgttcggtaccccgtccccgggtacccgtacccgg

SEQ ID NO: 201769 - DNA, 870 bp, Homo sapiens
  misc_feature: GYAE6OF01CZOJH.21.46.E02.1.454.CMB.1.raw
tcagtcgtcgctcgcacgaccggtgctcgatttagactcatctacagggaaagggggtggtccaggaggcagaactctgggtgtctcaccatggcctgactcctctacttcctcccctctcactctctgcagcggtctacgtgacggtccctactagtgacgtcgtacaaccacaccgcccctacccgttcggtcgttacgtacgtcccgtaccccggaaggaaccgacgggtaaccggcccgaaggtaccttaccaccgttgcccgttacgtacggacgaacggtaaggttaccggaacttaccggaaaacgtaaaaagttaaaacttcgttacgttacgtttaaaccggttaccggtaaaaccaacggtaaacgaaccggtaccgacccggtaccgtacccggttaccgttaggttacggttaagtacgtaaactaacgttaaaacggaaccgtaacgtacgtacgggaaccgtaccggaccgttaagaacggaccgttacccgtaccggtacgtacggtacctttacggtttcgtacggtcccgtaccgtccgtacggtaccggtaacggtaccgaacggtacttaacggtacgttacgttaaccggtacgtactttaaccgacggttaaggtaccggtaacgtacgggaacggggtaacaaggggtacccgtacgggtcgtaaccggttaactttacgtttaaccgtactaacggtaaccggattaacgggtaacacggttaagggtcgtaacgtttacgttagggtgggttaccggttaacggaccggtagggaacgtccgtaaacggtggtaacccgttcgaacgtccgcgtacccgtacgccgttccccgaccgtcggtaccc

SEQ ID NO: 201770 - DNA, 907 bp, Homo sapiens
  misc_feature: GYAE6OF01EQ97P.21.46.E02.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagactcatctacagggaaagggggtgggtccaggaggcagagctctgggaatctcaccatggcctcggacccctctccgtgcctccccctcctcacttttcngcactagtctctggacgcctctagtgacgctagaccacgacgcccctacccgtggtacgtccgacgttcccgaccccggaagggaaaccgaaaccgggtccgaacggtaaccttcccgtaacccgttgacccgttagggtaacggggactttaactttccgtaagttaaaccggaaaacctaaaaaaggttacttaacgttttaccgggtttcggtttacgggttaccacggtaaccggaacggtaacgtaccggaccggtacccccggaccggttaccccggttgtaccgttaccggcttaaccgtcgtacggtacggaaccggtaaccgacgggttaccgaaccgtacccggtaaccgggtccgggacccgttccggagtaaacgtcgtttccgttccgtctacccgttccgacgtacgccgtacggtacggaaccggtcggtaaccgtacccgtttaacgtacgtaccgttaacggtacggggtaaccgggtccggggaaccgtggggtaccgaaggttacgtaacggtacgtacgtacgttaaacgtttcgttaacgttaccggagtaacccccgaagtaccggtttaacgggtacgtacggttacgtaacgggtacggtacgggggttaccggggtacgggtacgggtaacccggggtacgtaaccggttcgggttaaccggtccgttaacggcgtaccggaacccggtccccaccgggtccccgtacgtacccgccgttctcccgttaacctcccggaccccttcg

SEQ ID NO: 201771 - DNA, 736 bp, Homo sapiens
  misc_feature: GYAE6OF01CGJX1.21.46.E02.1.454.CMB.1.raw
  modified_base (159)..(159): a, c, t, g, unknown or other
  misc_feature (159)..(159): n is a, c, g, or t
  modified_base (181)..(181): a, c, t, g, unknown or other
  misc_feature (181)..(181): n is a, c, g, or t
  modified_base (270)..(270): a, c, t, g, unknown or other
  misc_feature (270)..(270): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctcgtgacggcctctatgagcngacacacgcctacccgtcggtntcagtccgtacccaggacacggaccggccgaggactccgacctgcctcgtcgacgtagtacgtggacgtacaaaccgaaaaagtaactnttagtactttaacgtacgtaaaccaaacgacggaacgaccgaacggccgaccggtcctgttacggttagagtaagtaataacgtaacgacgtacgaggtaccggaccgtacccgttagaacgtacggtacctccggagtacgtacgttacttcgtcggtacgacctccacgtcgaacggacggacaggtacgtactagtacgttacgatacgtagagtacggactcggaacgacgacgggtacggacgacgtacgttagtaacgttacgttacgtacggtaaacgtaacgtaagtaaggaccggtaaggttagggtaacgttaaccgtgggttaggttcgggtaccgggtagggaaccgggtaaccggtaacgacggttaccgttaaccgggttaccgttaccggaaggtacccggtaaccgggaccccgtacggttacccccggttccggaccccgggttcccgg

SEQ ID NO: 201772 - DNA, 1199 bp, Homo sapiens
  misc_feature: GYAE6OF01AQB69.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctctatgagctgacacacgccaccctggtgtcagtcgcccaggacacggaccgccaggactccgacctcgtctctgaccagtacgtcggacctacgaaccaaaagtaaattacgtacgtaccgtttaacgttaaccggtaaccgaaacgaacgaaccggtacccggaaccgggacccggtaacccggttacccccggttaggtttaacgggtttaacggttaacggttaaaacgtttaaaacgttaaaaaccggttaaaaacccgggtaaaccgttaaccggtaacgggtaaaccggggtaacccgggtaccccgttaaaccgggtaaacgggttaacccgttaacccgttaccccggttaacgggtaaccggtaccggtttaccgtttaccgttaccgggttaccgggttaccccgttaacccggtaaccggttacccggttaaccggggtaaccggggtaaaccggtaaccgggttaaccggttaacccgggttaacccgggtttaaaccgggtttaaccggtttaaaccgtttaaaccggttaaccgggttaaaccggggtttaacccggggttaaaacccgggttaaccccgggaaaaccgggggtaaacccggggtaaacggggggtaaaacccggggggtaacccggggtaaaccggggtttaaaccggttaaaaccggtttaaaccccggttttttaaaacccgggtttttaaaaccccggggtttaaaacccgggtttaaaaacccccggggtttaaaaaaacccggggtttaaaacccgggggtttaaaaccggggttaaaaacccgggggtttaaaaccggggggttttaaaacccgggggtttaaaaaccccgggggtttttaaacccgggttttaaaccccggggggtttttaaacccgggggggtttttaacccgggggggtttttaaccccggggggggtttaaaccccggggggggttaaaaaccccggggggggtttaaaaaccccggggggtaaaaaccccggggtttaaacccggggggtttaaccccccgggg

SEQ ID NO: 201773 - DNA, 756 bp, Homo sapiens
  misc_feature: GYAE6OF01A63TM.21.46.E02.1.454.CMB.1.raw
  modified_base (245)..(245): a, c, t, g, unknown or other
  misc_feature (245)..(245): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctcctgaggcctcctatgagctgacacagcccaccctcggtgtcagtcgtccccaggacagacggccaggactccacctgctctgcagatggactgaccaaagaatntgtacttattcggaacctaacacgaacgccgacggccacggtcccctgtagttacgtgtattactanaacgacacgtcgagtccggacctanagtacgtacctccgtaggacgtccgtactttccgtacgtcgggtacccttaccgacggtaccgttaccggaacggggtaaccctaacggtaccgtaaccggttccgttaaccgggttacggtaaccttacgtaccgtaacgggtacggtaaccggtaccccgtaagggaccggaaagggtaacccgggacgacgggtaccttaccgggtaacctttacgtttaaccgtacgtaaccgtaaacggtcgttaacggaacccgtaagggttaaccggtaacgggttacccttacgggttaggtttacggggttccggtaccggggacgggtaaccgggtaccggaacgtccgtaacggtcccggttaccgtacggaccgtaaccgacccggtaacggcccgttcccggcccccgtttaccgg

SEQ ID NO: 201774 - DNA, 901 bp, Homo sapiens
  misc_feature: GYAE6OF01AY3DG.21.46.E02.1.454.CMB.1.raw
  modified_base (127)..(127): a, c, t, g, unknown or other
  misc_feature (127)..(127): n is a, c, g, or t
  modified_base (273)..(273): a, c, t, g, unknown or other
  misc_feature (273)..(273): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactntctgcacaggctctggacggcctcctatgagcttagacacacgaccctacccgtcgggtcgtcaggtccgtacccccgaagggaccgaacggaacgggcctaacgggactccaccctggtactccgtaggacgagacgtagggacncggaacaaaaggtaattagtcgtactttagtacggtaacaaacgaacgaacggaccgtacggaccgtaccgggtaccccttaggttacggttaaggtacggtaattaaacgtaaaacgtaaacggaaacctaaggtccggtaaacggtaaccgggacccttaggaacgtaaccggtacgttaacccggtggaaacgtaccgttacgtttacccgttcgggtaccgtcccgtacggtacgacgttacgggaacgggacctaccgggtacgaaccggttacgttaacggttcgtaaacgttaccgttaaggtaacggtaacggtaacgttaaccccggaaggggaacgaacgggaaccgggtaacgggtaacgggtacctaacgggtttaattaaccggtttagtaacccggtaaacgtaaacggtaacgtaaccggaaacggtaccggggttaaaggacgggtttaacttacccggggttaaggttacgggggtttacccgggacgggtaacggggtaaacggaaccgtacggttaccgggtacccggtaacccgggttacgtaccgggtaaccgtaccggaaccgggtacccgttcccgggtaccccgttccccggttaaacccgggg

SEQ ID NO: 201775 - DNA, 843 bp, Homo sapiens
  misc_feature: GYAE6OF01EX7EF.21.46.E02.1.454.CMB.1.raw
  modified_base (160)..(160): a, c, t, g, unknown or other
  misc_feature (160)..(160): n is a, c, g, or t
tcagtcgtcgctcgcacgaccggtgctcgattttagactcatctacagggaaagggggtgggtccaggaggcagaactcctgggtgtctcaccatggcctggactccctctacttctcccctctcactctctgcacaggctctgacggcctcctatcganctgacacgacgccctacccgtcggtagtcgtacgtcgtccccgaggaccgacggaccggccgaaggactaccaccgtcgccttactcggacgagtacgtcggtacgtacgaaccaaaaggtaacttagtcgttacgttacgttacggtaaacctaaacggacgtaaacggtaccgaaccgggtaccgtaaccggtaccccgtttaggtacggtttaagtaacgtaacgtttaaacgtaaagttaaaacgtaccgtaacggttaacggtaacggtaaccgggtaaccccgttaggaaacggttaaccggtaacctttaccccgggtagtaaaccggtaccgtttaacgtttacgtaccgtcgggtaccgtaaccgaacggtcctaacggacggaacgacgtaccgaacgttacgacgttaacgtacgttacgtacgtagtacgtaacgtacgacggacgaggtacggacgtaggtcgttcgaaactttagtaacgttacgaacgtaacgaacggttaagaaccgtaaagggttaccggtaacggttactagggtttaacgtttcggggggtaacgttaccggggaccgggaacggttaaccccgaacggttcgggttaacccggttacgacgtacccaccgggtaacccgtacgtcccgtaccccggtcccgtccggttaaccc

SEQ ID NO: 201776 - DNA, 723 bp, Homo sapiens
  misc_feature: GYAE6OF01ATYPA.21.46.E02.1.454.CMB.1.raw
  modified_base (503)..(503): a, c, t, g, unknown or other
  misc_feature (503)..(503): n is a, c, g, or t
  modified_base (605)..(605): a, c, t, g, unknown or other
  misc_feature (605)..(605): n is a, c, g, or t
tcagtcgtcgctcgcacgaccggtgctcgatttagactcatctacagggaaagggggtgggtccaggaggcagaactcgtgggtgtctcaccatggcctggactccctctacttcctcccctcctcacttctctgcacaggctactggacgcccttcctaatgacgctacgaccacacgccctacccgtggtacgtacgacggtccgtacccgaggaccacggaccggaccgaaggactacctaccgtcgtcttctggacgacgtagtacggtactacgaacaaagttaatcgtacgttacgttagtaccgtaacaacgaacgtacgccgacggaccgtacggtccgtagttgttaacgagtaatttaaacgtaaacgaacgtaacctacggtaggaacgtacccgggacccttagaacggtaccgttaaccgtccgggtaaggaaccgttcggttaactttccggtacgtacccggtactaccgaacggttcgaaccggganacgtagtacgtacgtacgtacgttacgtacgttaagacgtacggtacgtacgacggtgaacgaacgggagacgtagctaacgtctagtacgacaacgtaagngaacaggtactagggtaccttagggttacgggttgacggacggtcgggaattaccgcgtactcggtcgtacggaaacggccgtaacccggcgttaccggcccttcccggccggttacg

SEQ ID NO: 201777 - DNA, 244 bp, Homo sapiens
  misc_feature: GYAE6OF02HDYYM.21.46.E02.1.454.CMB.1.raw
  modified_base (242)..(244): a, c, t, g, unknown or other
  misc_feature (242)..(244): n is a, c, g, or t
tcagtcgtcgctcgcacgaccggtgctcgatttagactcatctacagggaaagggactggagtggttattattcctgggccagggaaccctggtaaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnn

SEQ ID NO: 201778 - DNA, 247 bp, Homo sapiens; identical to SEQ ID NO: 200681
  misc_feature: GYAE6OF02F9TRL.21.46.E02.1.454.CMB.1.raw
  modified_base (243)..(247): a, c, t, g, unknown or other
  misc_feature (243)..(247): n is a, c, g, or t

SEQ ID NO: 201779 - DNA, 247 bp, Homo sapiens; identical to SEQ ID NO: 200681
  misc_feature: GYAE6OF02I5CTB.21.46.E02.1.454.CMB.1.raw
  modified_base (243)..(247): a, c, t, g, unknown or other
  misc_feature (243)..(247): n is a, c, g, or t

SEQ ID NO: 201780 - DNA, 496 bp, Homo sapiens
  misc_feature: GYAE6OF02I6BRU.21.46.E02.1.454.CMB.1.raw
  modified_base (310)..(310): a, c, t, g, unknown or other
  misc_feature (310)..(310): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcagggacagcagtcacgttgactatcagtgaagtccaggcagaggacgaggctgactattactgtcaaacagtagacagtagaggtactgattgggtgttcgggcggagggaccgaaggctgaccgtctaggtcacgcccaggctgcccctcgg

SEQ ID NO: 201781 - DNA, 293 bp, Homo sapiens
  misc_feature: GYAE6OF02GHAQU.21.46.E02.1.454.CMB.1.raw
  modified_base (248)..(249): a, c, t, g, unknown or other
  misc_feature (248)..(249): n is a, c, g, or t
  modified_base (251)..(293): a, c, t, g, unknown or other
  misc_feature (251)..(293): n is a, c, g, or t
tcagtcgtcgctcgcacgaccggtgctcgatttagactcatctacagggaaagggactggagtggttattattcctggggccagggaaccctggtaaccgtctcctcagccgtccaccaagggcccatcggtcttcccctggcgccctgctccaggagcacctccgagaggcacagcggccctgggctgcctggtcaaggctacttccctcgtctcctaactgagcgggcttgggcaaggcgcatagnngnnnnnnnnnnnnnnnnnnnnnnnnnnnnnnnnnnnnnnnnnnn

SEQ ID NO: 201782 - DNA, 492 bp, Homo sapiens
  misc_feature: GYAE6OF02IZJXH.21.46.E02.1.454.CMB.1.raw
  modified_base (410)..(410): a, c, t, g, unknown or other
  misc_feature (410)..(410): n is a, c, g, or t
  modified_base (442)..(442): a, c, t, g, unknown or other
  misc_feature (442)..(442): n is a, c, g, or t
tcagtcgtcgctcgcacgaccggtgctcgatttagactcatctacagggaaaggggtgggtccaggaggcagaactctgggtgtctcaccatggcctggatcccctacttctcccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctcagctcagggacagcagtcacgttgactatcagtgaagtccaggcagaggacgaggctgactattactgtcaaacngtagacagtagaggtactcattggtgttcggnggagggaccaggctgaccgtcctaggcagcccaaggctcgcccctggtcc

SEQ ID NO: 201783 - DNA, 246 bp, Homo sapiens
  misc_feature: GYAE6OF02GV5GS.21.46.E02.1.454.CMB.1.raw
  modified_base (242)..(246): a, c, t, g, unknown or other
  misc_feature (242)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcctcgtctctactgagcgggctggcaaggcgcatagnnnnn

SEQ ID NO: 201784 - DNA, 245 bp, Homo sapiens; identical to SEQ ID NO: 200686
  misc_feature: GYAE6OF02HG974.21.46.E02.1.454.CMB.1.raw
  modified_base (243)..(245): a, c, t, g, unknown or other
  misc_feature (243)..(245): n is a, c, g, or t

SEQ ID NO: 201785 - DNA, 246 bp, Homo sapiens; identical to SEQ ID NO: 200672
  misc_feature: GYAE6OF02HMNBR.21.46.E02.1.454.CMB.1.raw
  modified_base (243)..(246): a, c, t, g, unknown or other
  misc_feature (243)..(246): n is a, c, g, or t

SEQ ID NO: 201786 - DNA, 244 bp, Homo sapiens
  misc_feature: GYAE6OF02F3865.21.46.E02.1.454.CMB.1.raw
  modified_base (243)..(244): a, c, t, g, unknown or other
  misc_feature (243)..(244): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnn

SEQ ID NO: 201787 - DNA, 506 bp, Homo sapiens
  misc_feature: GYAE6OF02H0SBO.21.46.E02.1.454.CMB.1.raw
  modified_base (414)..(414): a, c, t, g, unknown or other
  misc_feature (414)..(414): n is a, c, g, or t
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtcaggcagaggacgaggctgactattactgtacaaanagtagacagtagagtactcaagttgggtgttcgggnggagggaccgaaaggcgtgaccgtccgtaggtcagcccgaaggctcgccccctcgg

SEQ ID NO: 201788 - DNA, 246 bp, Homo sapiens
  misc_feature: GYAE6OF02I3FMZ.21.46.E02.1.454.CMB.1.raw
  modified_base (244)..(246): a, c, t, g, unknown or other
  misc_feature (244)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacgactgagcgggctggcaaggcgcatagnnn

SEQ ID NO: 201789 - DNA, 413 bp, Homo sapiens
  misc_feature: GYAE6OF02HQVSE.21.46.E02.1.454.CMB.1.raw
  modified_base (409)..(413): a, c, t, g, unknown or other
  misc_feature (409)..(413): n is a, c, g, or t
tcagtcgtcgctcgcacgaccggtgctcgatttagactcatctacagggaagggctggtctgggtctcacggattaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcccgagcgacgactgagcgggctggcaaggcgcatagnnnnn

SEQ ID NO: 201790 - DNA, 496 bp, Homo sapiens
  misc_feature: GYAE6OF02GCP6Z.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagaggtactcattgggtgttcggcggagggaccaaggctggaccgtctaggtcagccaaggctcgcccctcgg

SEQ ID NO: 201791 - DNA, 527 bp, Homo sapiens
  misc_feature: GYAE6OF02G7MKX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagagacgaggctgactattactgtcaaacagtagaacagtaagagtactacagttagggtgttcggcgggacgggtaaccgaaggacgtacggaccgtaccgtacggtacgacggacccgaacggcgtaccgcccctcccggg

SEQ ID NO: 201792 - DNA, 515 bp, Homo sapiens
  misc_feature: GYAE6OF02J271L.21.46.E02.1.454.CMB.1.raw
  modified_base (368)..(368): a, c, t, g, unknown or other
  misc_feature (368)..(368): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatcccctgagcgattctctggctcagctcgaggacagcagtcacgttgactancagtgaagtccaggcaggaggacgaggctaggactattacngtacaaagngtagacaagtagagttactntagttgggtagtcggacggagggaccaaggctagaccgttccgaggtacgacgacccgaaggcctcgccccgtacgg

SEQ ID NO: 201793 - DNA, 504 bp, Homo sapiens
  misc_feature: GYAE6OF02G5JLQ.21.46.E02.1.454.CMB.1.raw
  modified_base (241)..(241): a, c, t, g, unknown or other
  misc_feature (241)..(241): n is a, c, g, or t
  modified_base (319)..(319): a, c, t, g, unknown or other
  misc_feature (319)..(319): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtacagtgtccccaggacagacggccaggatcacctgctctgcctagatggactgccaaagaaatntggacttattggtaccaacagaaagccaggccaggccccctgtgttagtgactatataaagacactgagaggccctanagagatccctgagcgattctctggctccagctcagggacagcagtcacgttgactatcagtgaagtcaggcagaggacgaggctgactattactgtacaacagtacgacagtagagtacttgtattggtgttcggcggaggaccaaggctggaccgtctaggtcagcccaaggctcgcccctcgg

SEQ ID NO: 201794 - DNA, 246 bp, Homo sapiens; identical to SEQ ID NO: 200672
  misc_feature: GYAE6OF02JFDD8.21.46.E02.1.454.CMB.1.raw
  modified_base (243)..(246): a, c, t, g, unknown or other
  misc_feature (243)..(246): n is a, c, g, or t

SEQ ID NO: 201795 - DNA, 498 bp, Homo sapiens
  misc_feature: GYAE6OF02HJLDK.21.46.E02.1.454.CMB.1.raw
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacngtagacagtagagtactnagttgggtgttcggcgggaggaccaaggctgaccgtcgtaggtcagcccaggcctgcccctcgg

SEQ ID NO: 201796 - DNA, 493 bp, Homo sapiens
  misc_feature: GYAE6OF02IFXEM.21.46.E02.1.454.CMB.1.raw
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctcagagactccctgagcgattctctggctccagctcagggacagcagtcacgttgactatcagtgaagtccaggcagaggacgaggctgactattactgtacaaacagtagacagtagagtactntattggtgttcggnggaggacaagctagaccgtctaggtcagccgaggctcgcccctcg

SEQ ID NO: 201797 - DNA, 503 bp, Homo sapiens
  misc_feature: GYAE6OF02GX8N5.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctnagagatccctgagcgattctctggctcagctcaggacagcaatcacgttgactatcagtgaagtcaggcagaggacgaggctgactattactgtacaaacagtagacgagtagagtactcgagttgggtgttgggcggaggaccgaaggctggaccgttcgtaggtcacgcccaggcctcgcccccgtcgg

SEQ ID NO: 201798 - DNA, 511 bp, Homo sapiens
  misc_feature: GYAE6OF02I1D1Y.21.46.E02.1.454.CMB.1.raw
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacngtagacagtagaggtactnagttgggtgttcggcggagggacgaaggcgtggaaccgtccgtaggtcgacgcccgaaggcctcgcccccgtcgg

SEQ ID NO: 201799 - DNA, 556 bp, Homo sapiens
  misc_feature: GYAE6OF02H0J6O.21.46.E02.1.454.CMB.1.raw
  modified_base (412)..(412): a, c, t, g, unknown or other
  misc_feature (412)..(412): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatataataaagacactgagacggccctcagagatccctgagcgtattctctggctccagctcgagggacagcagtcacgttgactatcagtgaacgtcaggcagaggacgagctgactattacngtacaaacgagtaagacgtagtaagagttactacgtagttgggtgttcgggacgggacggggaaccgaaggtccgtacggtacccggttaccgtaagggtccgaacggtaccccgaaagggtcccttaccggcccccttccggg

SEQ ID NO: 201800 - DNA, 246 bp, Homo sapiens; identical to SEQ ID NO: 200672
  misc_feature: GYAE6OF02H4LKC.21.46.E02.1.454.CMB.1.raw
  modified_base (243)..(246): a, c, t, g, unknown or other
  misc_feature (243)..(246): n is a, c, g, or t

SEQ ID NO: 201801 - DNA, 506 bp, Homo sapiens
  misc_feature: GYAE6OF02H6CX8.21.46.E02.1.454.CMB.1.raw
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (456)..(456): a, c, t, g, unknown or other
  misc_feature (456)..(456): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagngatatataaaagacactgaagaggccctnagagatccctgagcgattctctggctccagctcagggacagcagtcacgttgactatcagtgaagtccaggcaggaggacgaggctgactattactgtacaaacagtaagacagtaagaggtactcagttgggtgttcggnggagggaccaagctgaccgtctaggtcaggcccaaggcctcgcccctcgg

SEQ ID NO: 201802 - DNA, 246 bp, Homo sapiens; identical to SEQ ID NO: 200672
  misc_feature: GYAE6OF02GVO5E.21.46.E02.1.454.CMB.1.raw
  modified_base (243)..(246): a, c, t, g, unknown or other
  misc_feature (243)..(246): n is a, c, g, or t

SEQ ID NO: 201803 - DNA, 491 bp, Homo sapiens
  misc_feature: GYAE6OF02FZEV8.21.46.E02.1.454.CMB.1.raw
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtcaggcagaggacgaggctgactattactgtcaaacagtagacagtagaggtactnattgggtnttcggcgagggacaagctgaccgtctaggtcagccaggctgcccctcgg

SEQ ID NO: 201804 - DNA, 495 bp, Homo sapiens
  misc_feature: GYAE6OF02I851X.21.46.E02.1.454.CMB.1.raw
  modified_base (419)..(419): a, c, t, g, unknown or other
  misc_feature (419)..(419): n is a, c, g, or t
  modified_base (433)..(433): a, c, t, g, unknown or other
  misc_feature (433)..(433): n is a, c, g, or t
  modified_base (446)..(446): a, c, t, g, unknown or other
  misc_feature (446)..(446): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcaggaggacgaggctgactattactgtacaacagtanacagtagagtactnagttggtgtcggnggaggacgaagctgaccgtcgtaggtcacgccgaaggctcgcccctcgg

SEQ ID NO: 201805 - DNA, 590 bp, Homo sapiens
  misc_feature: GYAE6OF02JWAG9.21.46.E02.1.454.CMB.1.raw
tcagtcgtcgctcgcacgaccggtgctcgatttagactcatctacagggaaaggggtgggtccacggaggcagaactactgggtgtcttcacctagtggcctggatccctctacttactcccctcctcgactctcctgcgactagggctctagagggttcctccttatgtagttactggacaccaggtcctaccctacggtgtcaagtggtcccgaggtacagggacggccaggactcgacctggcgtctgcagatcggacctggccaaagaatactgcgtttatcggttaccaacgtagaacgtccgaggacctagggccccctaggtggttacgtcgaactactaagtaaacgacgacttggagagggcctcagtagtactacctgagcggattcgtcgtgactcgagctcgagggacacgcaggtcacgttgacctatcagtagaacgtccaggtcaggagacgaggctagtactacttagagtacaactaggtacagagtagaggtactcagttggtgttacggaggagggtaccaggcgtagtaccgtcgtacggtctaggacccgaggcggtacgcccggtcgg

SEQ ID NO: 201806 - DNA, 502 bp, Homo sapiens
  misc_feature: GYAE6OF02IEPJ2.21.46.E02.1.454.CMB.1.raw
  modified_base (451)..(451): a, c, t, g, unknown or other
  misc_feature (451)..(451): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcatgttgactatcagtgaagtccaggcagaggacgaggctgactattactgtacaaacagtagacagtagagttactcaagttgggtgttcggnggagggaccaaggctagaccgtacgtaggtcagcccaaggcctgtcccccg

SEQ ID NO: 201807 - DNA, 512 bp, Homo sapiens
  misc_feature: GYAE6OF02JAZNN.21.46.E02.1.454.CMB.1.raw
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatcccctgagcgattctctggctccagctcagggacagcagtcacgttgactatcagtgaagtccaggcagaggacgaggctgactattactgtacaaacagtaganagtagagtactgagtttgggtcgttcgggcggagggaccgaaggcctggacccgtcgtaggtcgacggcccaaggcctcgccccgtcgg

SEQ ID NO: 201808 - DNA, 506 bp, Homo sapiens
  misc_feature: GYAE6OF02F6HZZ.21.46.E02.1.454.CMB.1.raw
  modified_base (454)..(454): a, c, t, g, unknown or other
  misc_feature (454)..(454): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatccctgagcgattctctggctcagctcagggacagcagtcacgttgactatcagtgaagtcaggcagaggacgaggctgactattactgtacaaacagtaagacagtagaggttactcgtagttgggtgttcggnggaggaccgaaggctgaccgtcgtaggtcagcccgaaggctcgccccgtcgg

SEQ ID NO: 201809 - DNA, 501 bp, Homo sapiens
  misc_feature: GYAE6OF02GMCX8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagaggtactcattgggtgttcggcggagggaccaaggctaggaccgtcctaggtcagcccaaggctcgcccctcgg

SEQ ID NO: 201810 - DNA, 497 bp, Homo sapiens
  misc_feature: GYAE6OF02FY7S3.21.46.E02.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcagggacagcagtcacgttgactatcagtgaagtccaggcagaggacgaggctgactattactgtacaaacagtagacagtagagtactcattgggtgttcggcggagggaccgaagctgaccgtcgtaggtcagcccaaggctcgcccctcgg

SEQ ID NO: 201811 - DNA, 520 bp, Homo sapiens
  misc_feature: GYAE6OF02ISIVF.21.46.E02.1.454.CMB.1.raw
  modified_base (315)..(315): a, c, t, g, unknown or other
  misc_feature (315)..(315): n is a, c, g, or t
  modified_base (419)..(419): a, c, t, g, unknown or other
  misc_feature (419)..(419): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttagtgatatataaagacaactgagaggccctnagagatccctgagcgattctctggctccagctcagggacagcagtcacgttgactatcagtgaagtccaggcagaggacgaggctgactattactgtacaaacngtaagacaagtagaggtactcagttgggtgttcgggcggaagggaccgaaggcgtggacccgtacgtaggtaccaggcccgaaggcctcgcccccgtacgg

SEQ ID NO: 201812 - DNA, 493 bp, Homo sapiens
  misc_feature: GYAE6OF02F4MB0.21.46.E02.1.454.CMB.1.raw
  modified_base (449)..(449): a, c, t, g, unknown or other
  misc_feature (449)..(449): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagaggtactcattgggtgttcggngagggaccaagctgaccgtctaggtcagccaggctgcccctcgg

SEQ ID NO: 201813 - DNA, 506 bp, Homo sapiens
  misc_feature: GYAE6OF02IWN38.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagaggtactgattgggtgttcggcggagggaccgaagctggacccgtcgtaggtcacggacccaggcctcgccccctccgg

SEQ ID NO: 201814 - DNA, 497 bp, Homo sapiens
  misc_feature: GYAE6OF02I38XV.21.46.E02.1.454.CMB.1.raw
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctagactatactgtacaaacngtagacagtagaggtactanattgggtgttcgggngagggaccagctgaccgtcgtaggcagcccaaggctacgcccctcgg

SEQ ID NO: 201815 - DNA, 244 bp, Homo sapiens
  misc_feature: GYAE6OF02H6HEY.21.46.E02.1.454.CMB.1.raw
  modified_base (241)..(244): a, c, t, g, unknown or other
  misc_feature (241)..(244): n is a, c, g, or t
tcagtcgtcgctcgcacgaccggtgctcgatttagactcatctacagggaaagggactggagtggttattattcctggggccagggaacctggtaaccgtctcctcagcctccaccaagggcccatcggtcttcccctggcgccctgctccaggagcacctccgagagcacagcggccctgggctgcctggtcaaggactacttccctgtctctactgagcgggctggcaaggcgcatagnnnn

SEQ ID NO: 201816 - DNA, 255 bp, Homo sapiens
  misc_feature: GYAE6OF02GHKK7.21.46.E02.1.454.CMB.1.raw
  modified_base (244)..(255): a, c, t, g, unknown or other
  misc_feature (244)..(255): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggcctacttcccgagcgacgactgagcgggctggcaaggcgcatagnnnnnnnnnnnn

SEQ ID NO: 201817 - DNA, 494 bp, Homo sapiens
  misc_feature: GYAE6OF02I1VXC.21.46.E02.1.454.CMB.1.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttatggtaccaacagaagccaggcaggccctgtgttagtgatatataaagacactgagaggccctnagagatccctgagcgattcnctggctccagctcagggacagcagtcacgttgactatcagtgaagtccaggcagacggacgaggctgactagttactgtcaaacngtacganagtagagtactcattgggtgttcggcgaggaccgaagactgaccgtctaggtcagcccaaggctacgcccctcgg

SEQ ID NO: 201818 - DNA, 518 bp, Homo sapiens
  misc_feature: GYAE6OF02JAFUL.21.46.E02.1.454.CMB.1.raw
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaaagacactgagaggccctcagagatccctgagcgattctctggcctcagctcagggacagcagtcacgttgactatcagtgaagtccagcagaggacgaggctgactattactgtacaaanagtanacagtagaggtactcgattgggtgtttcggcggtaagggaccgaaaggccgtggaacccgtccgtaggtcacggcccgaaggctcgcccccgttacgg

SEQ ID NO: 201819 - DNA, 511 bp, Homo sapiens
  misc_feature: GYAE6OF02JNH8M.21.46.E02.1.454.CMB.1.raw
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
  modified_base (415)..(415): a, c, t, g, unknown or other
  misc_feature (415)..(415): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattcnctggctccagctcagggacagcagtcacgttgactatcagtgaagtccaggcagaggacgaggctgactattactgtacaaacngtagacagtaagagtactcagttgggtgttcggacggagggaccaaggtcgtgaaccgtccgtaaggtcgaggcccgaaggccgtcgccccctcgg

SEQ ID NO: 201820 - DNA, 505 bp, Homo sapiens
  misc_feature: GYAE6OF02I6YGU.21.46.E02.1.454.CMB.1.raw
  modified_base (331)..(331): a, c, t, g, unknown or other
  misc_feature (331)..(331): n is a, c, g, or t
  modified_base (448)..(448): a, c, t, g, unknown or other
  misc_feature (448)..(448): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattcnctggctccagctcagggacagcagtcacgttgactatcagtgaagtcaggcagaggacgaggctgactattactgtcaaacagtaagacagtagaggtactcagttgggtgttcggnggagggtaccgaaggctggaccgttcgtaggtcagcccaaggcctggccccctacgg

SEQ ID NO: 201821 - DNA, 507 bp, Homo sapiens
  misc_feature: GYAE6OF02IL9E7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagactcctgagcgattctctggctccagctcagggacagcagtcacgttgactatcagtgaagtccaggcagaggacgaggctagactattactgtacaaacagtagacagtagaggtactcgagtttgggtgttcggcggagggtaccaaggtctagaccgtcctaggtcagcccgaaggctcgcccctcgg

SEQ ID NO: 201822 - DNA, 500 bp, Homo sapiens
  misc_feature: GYAE6OF02G60VI.21.46.E02.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtcaggcagaggacgaggctgactatactgtacaacagtagacagtagagtactnagttgggtgtggcggagggaccgaagctaggacccgtcgtaggacacgcccgaaggctcgcccccgtcgg

SEQ ID NO: 201823 - DNA, 493 bp, Homo sapiens
  misc_feature: GYAE6OF02G559I.21.46.E02.1.454.CMB.1.raw
  modified_base (311)..(311): a, c, t, g, unknown or other
  misc_feature (311)..(311): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcagggacagcagtcacgttgactatcagtgaagtccaggcagagacgaggctgactattactgtacaaacagtagacagtagagtactcagttgggtgttcggcggaggaccgaagctgaccgtctaggtcagccaggctcgcccctcgg

SEQ ID NO: 201824 - DNA, 501 bp, Homo sapiens
  misc_feature: GYAE6OF02GPN22.21.46.E02.1.454.CMB.1.raw
  modified_base (482)..(482): a, c, t, g, unknown or other
  misc_feature (482)..(482): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctcagagatccctgagcgattctctggctccagctcgagggacagcagtcacgttgactatcagtgaagtccaggcagaggacgaggctgactattactgtacaaacagtagacagtagagttactcagttggtgttcggcggaggacgaaggctcgaccgttcgtaggtcngccgaggctcgcccctcgg

SEQ ID NO: 201825 - DNA, 510 bp, Homo sapiens
  misc_feature: GYAE6OF02IEY6N.21.46.E02.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgtagtgatatataaagacactgagaggccctcagagatccctgagcgattctctggctccagctnaggacagcagtcacgttgactatcagtgaagtccaggcagaggacgaggctgactattactgtacaacagtagacagtagaggtactgagttgggtgttcgggcggagggaccgaagtcgtggaccgttccgtaggtccaggccccgaaggccttcggccccctcgg

SEQ ID NO: 201826 - DNA, 530 bp, Homo sapiens
  misc_feature: GYAE6OF02I666Y.21.46.E02.1.454.CMB.1.raw
  modified_base (415)..(415): a, c, t, g, unknown or other
  misc_feature (415)..(415): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactattactgtacaaacngtagacagtagaggtactacgtagttgggtagtttcgggacgggtagggaccgaaggccgttaggacccgttccgtaggtcacggtcccgaagggcctccggcccccgttaccgg

SEQ ID NO: 201827 - DNA, 563 bp, Homo sapiens
  misc_feature: GYAE6OF02HOGJ6.21.46.E02.1.454.CMB.1.raw
  modified_base (446)..(446): a, c, t, g, unknown or other
  misc_feature (446)..(446): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
  modified_base (537)..(537): a, c, t, g, unknown or other
  misc_feature (537)..(537): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcgatgacgtcgccgaaacgaaagtaatagcgttaactttaggttaaccgaaaccaaggaaaggaccgaacggaccgacggacccccgtccgtggtttaggtacgagtattaataaaagtaacgacctagtagaaggcccgtacctagaagaagtcccttcgagacgattactctggcgtccagctcagggacgagacacgtcgacgtgtacatcagtgaagtccaggnagaggacgagntcgatattacngtcaaacagtgacagtagaggtctacnttaggtgttcggnggagggaccaagctagaccgtctacgganagcccaaggtcgctccccgtcggtac

SEQ ID NO: 201828 - DNA, 590 bp, Homo sapiens
  misc_feature: GYAE6OF02JZWE7.21.46.E02.1.454.CMB.1.raw
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
  modified_base (528)..(528): a, c, t, g, unknown or other
  misc_feature (528)..(528): n is a, c, g, or t
tcagtcgtcgctcgcacgaccggtgctcgatttagactcatctacagggaaagggggtgggtccgaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatntgcttatggtaccaacagaagccaggccaggcccctgtgttagtgatatataaagacactgagacggccctnagagactcccctgacgcgtatttctcgttgggaccttcccgagcctacgaacggggtacaagccgaggtccacgtttcgacttatacagtaggaaacgtcccgaaggaccaaggacggtaacgaggtctagaacttagttactgtaacaaacgagtaacgacgtagtaaggaggttaactgagtttggggtgttcgggcggtaagggaccaaggngttacggtaaccgttccgttaggacctacggccccgtaagggaccctccggtaccccctcgg

SEQ ID NO: 201829 - DNA, 499 bp, Homo sapiens
  misc_feature: GYAE6OF02HT3VI.21.46.E02.1.454.CMB.1.raw
  modified_base (378)..(378): a, c, t, g, unknown or other
  misc_feature (378)..(378): n is a, c, g, or t
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatcccctgacgcgattctctggctccagctcagggacagcagtcacgttgactatcagtnaagtcagcagaggacgaggctagactattactgtacaaanagtagacagtagagtactcagttggtgttcggnggagggacaagctagaccgtctaggcacgcccaaggctcgcccctcgg

SEQ ID NO: 201830 - DNA, 524 bp, Homo sapiens
  misc_feature: GYAE6OF02FQ48M.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccgggacaaacggccaggatcacctgctctggagatgcattgaccaaaaaattntgttttttggaccagcagaagtcaggccaggcccctgtgttggtcatccatgaggacaggagacgaccctccgggatccctgagagattctctggctccaactcagggacggtggccacgttgattctcgagtggggcccagggtggaggatgaagctgactactactgttactcagcagacagcagtggtcatcgaggggcagttcggcggagggaccaggttgaccgtcgtaggcaggcccaaggctcgcccctggtcacgtctcgtcccacctcctcccg

SEQ ID NO: 201831 - DNA, 513 bp, Homo sapiens
  misc_feature: GYAE6OF02HUWBF.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagactccctgagcgattcctctggctccagctcgagggacagcagtcacgttgactatcagtgaagtccaggcagaggacgaggctagactattactgtacaaagagtaagacaagtagagtactcgagttgggtgttcggaggacggacgaaggctagaccgtcgtaggtcacgacccgaaggcctcggcccctcgg

SEQ ID NO: 201832 - DNA, 507 bp, Homo sapiens
  misc_feature: GYAE6OF02GNJCV.21.46.E02.1.454.CMB.1.raw
  modified_base (315)..(315): a, c, t, g, unknown or other
  misc_feature (315)..(315): n is a, c, g, or t
  modified_base (419)..(419): a, c, t, g, unknown or other
  misc_feature (419)..(419): n is a, c, g, or t
  modified_base (455)..(455): a, c, t, g, unknown or other
  misc_feature (455)..(455): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggccccctgtgttagtgatatataaagacactgagaggccctnagagatccctgagcgattctctggctccagctcagggacagcagtcacgttgactatcagtgaagtccaggcagaggacgaggctgactattactgtacaaacngtagacagtagaggtactcgagttgggtgttcgggnggagggaccgaaggctggaccgtctaggcaggcccaaggctcgccccgtcgg

SEQ ID NO: 201833 - DNA, 527 bp, Homo sapiens
  misc_feature: GYAE6OF02IFZ87.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggccccctgtgttagtgatatataaagacactgagaggccctcagagatcccctgagcgattctctggctccagctcagggacagcagtcacgttgactatcagtgaagtcaggcagaggacgaggctgactattactgtacaaacagtaagacagtagaggttactacgagttgggtgttcgggcgggagggaccgaaggctagacccgttcctagggtccacgaccccgaaggcctccggcccccgttaccgg

SEQ ID NO: 201834 - DNA, 510 bp, Homo sapiens
  misc_feature: GYAE6OF02GIZAU.21.46.E02.1.454.CMB.1.raw
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactaccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaangtaagacagtagaggtactntagttgggtgttcggcggagggaccaaggctacgaccgtcctaggtcacgcccaaggcctcgcccccgtggtacc

SEQ ID NO: 201835 - DNA, 545 bp, Homo sapiens
  misc_feature: GYAE6OF02G3K6Y.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgcttattggtaccaacagaagccaggccaggcccctgtgttagtgatatataaagacactgagaggccctnagagactccctgagcgtaattctctggcctccagctcgagggacagcagtcacgttcgaactatcagtgaagtccaggacagacggacgaggctagaactattacgtagtactaaagtacgtaagactaaggtagtaaggtacttacgagttcgggtagttcgggacggagggaaccgaaggtctacggaccgttcgtaggtcacggaccgtaggctccggccccgtaccgg

SEQ ID NO: 201836 - DNA, 496 bp, Homo sapiens
  misc_feature: GYAE6OF02IQ96C.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttatggtacaacagaagccaggccaggcccctgtgtagtgatatataaagacactgagaggccctcagagatccctgagcgattctctggctcagctcaggacagcagtcacgttgactatcagtgaagtcagcagagacgaggctagactattactgacaaacagtagacagtagagtactcagttggtgttcgcggtaggaccaagctgaccgtctaggtctacggccgaaggcgtacgcccccgttacgg

SEQ ID NO: 201837 - DNA, 552 bp, Homo sapiens
  misc_feature: GYAE6OF02F47BY.21.46.E02.1.454.CMB.1.raw
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaanagtaagacagtagaggttactcgagtttggggtagtttcgggacgggtaaggggacccaaagggccgttacggaacccggttccgtaagggttccaacggaccccgaaagggtccgtaccggccccccgttaccggg

SEQ ID NO: 201838 - DNA, 503 bp, Homo sapiens
  misc_feature: GYAE6OF02IJ3DF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtacaacagaagccaggccaggccccctgtgttagtgatatataaaagacactgagaggccctcagagatccctgagcgattctctggctccagctcagggacagcagtcacgttgactatcagtgaagtccaggcagaggacgaggctgactattactgtacaaacagtagacagtaagaggtactcgattgggtgttcgggcggagggaccaagctagaccgtcctaggtcaggccaaggctcgcccctcgg

SEQ ID NO: 201839 - DNA, 665 bp, Homo sapiens
  misc_feature: GYAE6OF02JNM4C.21.46.E02.1.454.CMB.1.raw
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
tcagtcgtcgctcgcacgaccggtgctcgatttagactcatctacaggaaagggggtaggggtccgaggagggcgagaactactgggtggtctcaccatggcctggatcctctacttctcccctcctccactctctgcacaggctctgaggcctcctatgagctgacacagccaccctcggtgtcagtgtccccaggacagacggccaggatcacctgctctgcagatggactgaccaaagaaatatgacttattggtaccaacagaagccaggccaggcccctgtgttagtgagtatataaagacactgagagccctnaganactccctagagcaattctctggctccgagctacgaacgggacctagcaacggtctaacggttgtaactatacacgtagtaacgtaccgacgtacgaacggaggaacggaagggtcgtacggtaacttaacgttaacttacggtacaaacgtaacgtaagtaaccgtaaggtaagggtaaggtaacgttacgtaaagtttaggggtgggttttaccgggacgggttacggggaaccggtaaacgggtaccttacggggaacccggttacccggttaacgggttacccggtaacggtaccccggtaaccgggtaaccggttcccggacccccggttaccccggg

SEQ ID NO: 201840 - DNA, 508 bp, Homo sapiens
  misc_feature: GYAE6OF02IQGEY.21.46.E02.1.454.CMB.1.raw
  modified_base (332)..(332): a, c, t, g, unknown or other
  misc_feature (332)..(332): n is a, c, g, or t
  modified_base (415)..(415): a, c, t, g, unknown or other
  misc_feature (415)..(415): n is a, c, g, or t
  modified_base (442)..(442): a, c, t, g, unknown or other
  misc_feature (442)..(442): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctcagagatccctgagcgattcnctggctccagctcagggacagcagtcacgttgactatcagtgaagtccaggcagaggacgaggctgactattactgtacaaangtagacagtagagtactcgatttgggngttcgggcggaagggaccaaggctacggaccgtccgtagtcacggcccaagggctccgcccctcgg

SEQ ID NO: 201841 - DNA, 497 bp, Homo sapiens
  misc_feature: GYAE6OF02GZ5DD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatcccctgagcgattctctggctccagctcagggacagcagtcacgttgactatcagtgaagtcagcagaggacgaggctgactattactgtcaaacagtagacagtagaggtactcattgggtgttcggcggagggaccaaggctgaccgtctaggtcagcccaaggctcgcccctcgg

SEQ ID NO: 201842 - DNA, 507 bp, Homo sapiens
  misc_feature: GYAE6OF02HILFJ.21.46.E02.1.454.CMB.1.raw
  modified_base (241)..(241): a, c, t, g, unknown or other
  misc_feature (241)..(241): n is a, c, g, or t
  modified_base (446)..(446): a, c, t, g, unknown or other
  misc_feature (446)..(446): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatntgcttattggtaccaacagaagccaggccaggcccctgtgttagtgatatataaaagacactgagaggccctcagagactccctgagcgattctctggctccagctcgagggacagcagtcacgttgactatcagtgaagtccaggcaggagacgaggctagactattactgacaaacagtagacagtagagtactcattgggtnttcgggcggagggaccaaggctgaccgtccgtaggtcacgcccgaaggctcggcccctcgg

SEQ ID NO: 201843 - DNA, 512 bp, Homo sapiens
  misc_feature: GYAE6OF02H23UN.21.46.E02.1.454.CMB.1.raw
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctnagagatccctgagcgattctctggctccagctcagggacagcagtcacgttgactatcagtgaagtccaggcagaggacgaggctgactattactgtacaaacagtagacagtagagtactnagttgggtgttcggacgggagggaccaaggtcgtacgaccgtccgtaggtcacgcccgaaggcctacggcccctacgg

SEQ ID NO: 201844 - DNA, 507 bp, Homo sapiens
  misc_feature: GYAE6OF02JT88M.21.46.E02.1.454.CMB.1.raw
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatataataaagacactgagaggccctcagagatccctgagcgattctctggctccagctcagggacagcagtcaacgttgactatcagtgaagtcaggcagagacgagctagactatacngtacaaangtagacagtagaggttacnctagttgggtgttggcggaggacgaaggcgtaggaccgtcgtaggtccagacccgaaggcctacgccccctacgg

SEQ ID NO: 201845 - DNA, 521 bp, Homo sapiens
  misc_feature: GYAE6OF02JFPDG.21.46.E02.1.454.CMB.1.raw
  modified_base (335)..(335): a, c, t, g, unknown or other
  misc_feature (335)..(335): n is a, c, g, or t
tcagtcgtcgctcgcacgaccggtgctcgatttagactcatctacagggaaagggggtgggtccaggaggcagaactctgggtgtctcaccagtggcctggatccctctaccttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattcnctggctccagctcgagggacagcagtcacgttgactatcagtgaagtccaggcagaggaccgaggctgactattactgtacaaacagtacgacagtaagaggtactcgtagttgggtgttacgggcggtaagggaccaaggcgtggaccgtcgtaggccgagcccgaaggcctcgccccctacggg

SEQ ID NO: 201846 - DNA, 673 bp, Homo sapiens
  misc_feature: GYAE6OF02F41G4.21.46.E02.1.454.CMB.1.raw
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaaggacctggagtggttattattcctgggccagggaaccctggtaaccgtcgtccctcagcctccaccaaggggcccactcggtcttcccctggcgcccgtgcctccgaggacgcaccttccgagacgctaccagtcggcccctgggctcgcctggtccaaggctacttcccgagcgacgacgtgagcgggctggccaaaggtccgcctagtacggcagtcgagcatagagttattcgcctgttcagcagaaaccgnggtaacncccctaaatccgtgactacgtacgctcgacactacctacttcgtacgacgtacgtcggtccgtcgtacgtacgtacgcggacgacgtacggtacgtcgtacggacgtacgtacgttactactactactacgtacgtacgacgacgtacgtcgtacgacgacgtacgtacgtacgtacgtcgtacgtacgttaacgttacgttacgttacgtactactacgtacgttaacgtaaccgtaaccgtaccgttacgttacgttacgtaccggtacggtaacgtacgtacggtacgtaacgtaacgtaacgtaacgtacgtacgtacgtacgtacgtacgtacgtacgtacgttacgtactacg

SEQ ID NO: 201847 - DNA, 514 bp, Homo sapiens
  misc_feature: GYAE6OF02GKVWT.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagattgactgccaaagaaatatgcttattggtaccaacagaagccaggccaggccccctgtgttagtgatatataaagacactgagaggccctnagagatccctgagcgattctctggctccagctcagggacagcagtcacgttgactatcagtgaagtccaggcagaggacgaggctgactattactgtacaaacagtagacagtaagaggtactcagtttgggtgttcggcggagggaccgaaggctaggacccgttccgtaggtcacggcccgaaggcctcgccccctcgg

SEQ ID NO: 201848 - DNA, 741 bp, Homo sapiens
  misc_feature: GYAE6OF02JJ8TV.21.46.E02.1.454.CMB.1.raw
  modified_base (643)..(643): a, c, t, g, unknown or other
  misc_feature (643)..(643): n is a, c, g, or t
  modified_base (680)..(680): a, c, t, g, unknown or other
  misc_feature (680)..(680): n is a, c, g, or t
tcagtcgtcgctcgcacgaccggtgctcgatttagactcatctacagggaaagggggtgggtccaggaggcagaactctgggtgtctcaccatggcctgatcctctacttctcccctcctcactctctgcacaggctctgaggcctcctatgagctgacacacgccaccctcggtgtcagtcgtcccgacggacacgacggaccgacggactacacctcgctctgctagacgtacggactgaccgaaacgaaaactaagtagtacgttaacgtttaggttacccaaacgtaacggtaaacgtaccgtaacgggacccgaacgggtaccccgtacggttacggtttaacggttacggtaacgttaacgttaaacgttaaaacggtaaacgtaaacgttaacggtaacggtaaacgggtaaccccgtaaccgaacggtaacggtaaacgttacccgtacggtaacggtacggtaacgtttaccgttacgttacggtaccgtaccgtaacgtaccgtacgtaacgggtaaccgaacggacgtaacgtacgtaacggttacgtaacgttaacgtacgtaacgtaacgtaaacgtaccgtaacggtacgtaacggtaacggaacggaacgggtacgtacggaacgttnaacttaacgttacgtacgtaactaacgtaacgtaacngtaacgtaaggtaaggtaacgtacgtaacgttagggttacgggttacggtacgggtacggg

SEQ ID NO: 201849 - DNA, 246 bp, Homo sapiens
  misc_feature: GYAE6OF02FL5K1.21.46.E02.1.454.CMB.1.raw
  modified_base (244)..(246): a, c, t, g, unknown or other
  misc_feature (244)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgtgagcacagcggccctgggctgcctggtcaaggactacttcccgagcgacgactgagcgggctggcaaggcgcatagnnn

SEQ ID NO: 201850 - DNA, 498 bp, Homo sapiens
  misc_feature: GYAE6OF02H36IU.21.46.E02.1.454.CMB.1.raw
  modified_base (442)..(442): a, c, t, g, unknown or other
  misc_feature (442)..(442): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcaagaggacgaggctgactattactgtacaaacagtagacagtagaggtactcattgggngttcggcggaggaccaaggctgaccgtcctaggtcagcccaaggctagcccctcgg

SEQ ID NO: 201851 - DNA, 511 bp, Homo sapiens
  misc_feature: GYAE6OF02GYF9I.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgtagtgatatataaagacactgagaggccctnagagatcctgagcgattctctggctccagctcaggacagcagtcacgttgactatcagtgaagtccaggcagaggacgaggctgactattactgtacaaacagtagacagtagaggtactcagttgggtgttcgggcggagggaccgaaggcgtagaccgtccgtaggtccacggcccaaggctacggccccctaccgg

SEQ ID NO: 201852 - DNA, 247 bp, Homo sapiens; identical to SEQ ID NO: 200757
  misc_feature: GYAE6OF02GRQIL.21.46.E02.1.454.CMB.1.raw
  modified_base (243)..(247): a, c, t, g, unknown or other
  misc_feature (243)..(247): n is a, c, g, or t

SEQ ID NO: 201853 - DNA, 494 bp, Homo sapiens
  misc_feature: GYAE6OF02HVM7K.21.46.E02.1.454.CMB.1.raw
  modified_base (407)..(407): a, c, t, g, unknown or other
  misc_feature (407)..(407): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcaggacagcagtcacgttgactatcagtgaagtccaggcagaggacgaggctgactattactntacaaacagtagacagtagagtactcagttggtgtcggcggaggaccgagtcgtgaccgtcgtagcagcccaaggctcgcccctcgg

SEQ ID NO: 201854 - DNA, 246 bp, Homo sapiens
  misc_feature: GYAE6OF02FULEK.21.46.E02.1.454.CMB.1.raw
  modified_base (242)..(246): a, c, t, g, unknown or other
  misc_feature (242)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcccgagcacgactgagcgggctggcaaggcgcatagnnnnn

SEQ ID NO: 201855 - DNA, 507 bp, Homo sapiens
  misc_feature: GYAE6OF02JER2W.21.46.E02.1.454.CMB.1.raw
  modified_base (414)..(414): a, c, t, g, unknown or other
  misc_feature (414)..(414): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaangtagacagtagaggtactcattggattggtacggaggacggaacagtcgtacgtaccgtacgtacgtacgaccgacgacgcgtcccgtcccgg

SEQ ID NO: 201856 - DNA, 509 bp, Homo sapiens
  misc_feature: GYAE6OF02FXBS6.21.46.E02.1.454.CMB.1.raw
  modified_base (416)..(416): a, c, t, g, unknown or other
  misc_feature (416)..(416): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactatactgtacaaacngtagacagtagaggttactcagttgggtgttcggcggagggaccaaggctaggaccgtcctaggtcacggacccaaggctcgcccccgtacgg

SEQ ID NO: 201857 - DNA, 536 bp, Homo sapiens
  misc_feature: GYAE6OF02IWET8.21.46.E02.1.454.CMB.1.raw
  modified_base (271)..(271): a, c, t, g, unknown or other
  misc_feature (271)..(271): n is a, c, g, or t
  modified_base (347)..(347): a, c, t, g, unknown or other
  misc_feature (347)..(347): n is a, c, g, or t
tcagtcgtcgctcgcacgaccggtgctcgatttagactcatctacaggggaaaggggtgggtccaggaggcagaactctgggtgtcttcaccatggcctggatccctctacttctcccccctcctcactctctgcactaggctctgagggtcctcctatgagtctgacaccagccaccctcggtgtcagtgtccccaggacagacgggccagggatccacctgctctgcagatggactgccaaagaaatatgctattggtaccaacagaancccaggccaggccccctgtgttagtgatactataaagacacgtgaagaggccctcaggagatccctgagcgattcnctggctcagctcaggacagcagtcacgttgacctatcagtgaagtccaggcaggaggacgaggtctagacttattactgtacaaacagtagacagtagagtactcgagttgggtgttcgggacggtagggaccgtaaggctaggacccgtacgtaggtacgcgtacccgaggcgttcgccccgttacgg

SEQ ID NO: 201858 - DNA, 650 bp, Homo sapiens
  misc_feature: GYAE6OF02JN3CH.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacaggaaagggggtaggggtccgaggagggcgagaactactgggtggtctcaccatggcctggatcctcctacttctccccctcctccactctctgcacaggctctgaggcctcctatgagctgacacagccaccctccggtgtcagtgtccccaggacagaacggccaggatcacctgctctgcagatggactgccaaaagaaatatgctattgtacacagaagccaggccaggcccctgtgtacgtgatatataaagaacatagagaggccctnaacgacgatccccgtgacgcgtattaccttcgttggcctccaacgccttacgaacggggactacgacgacgacgtacgttacgtacgtactacgacgttacgaacggttacccgagggacgaacgggaggaaccggtacgggacctaggtaaccgttaattaccgttagtaccaaaagtaacgtaggaacctaggtaacggtaaggttaaccttagtacggttgggttacgggttccgggtacggaggggaccgaaccgggtataccgggtaccggtacccgttaagggccgaaccgtccggaacggtcccggaccgtcccccggtaccgg

SEQ ID NO: 201859 - DNA, 506 bp, Homo sapiens
  misc_feature: GYAE6OF02F2GE0.21.46.E02.1.454.CMB.1.raw
  modified_base (312)..(312): a, c, t, g, unknown or other
  misc_feature (312)..(312): n is a, c, g, or t
  modified_base (415)..(415): a, c, t, g, unknown or other
  misc_feature (415)..(415): n is a, c, g, or t
  modified_base (452)..(452): a, c, t, g, unknown or other
  misc_feature (452)..(452): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctcagctcgaggacagcagtcacgttgactatcagtgaagtccaggcagaggacgaggctagactattactgtacaaanagtagacgtagtagagtactgtagttgggtgttcggnggaggaccgaaggctcgaccgtcgtaggtcacgcccgaaggcctcgcccctcgg

SEQ ID NO: 201860 - DNA, 523 bp, Homo sapiens
  misc_feature: GYAE6OF02I2WJF.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctnagagatccctgagcgattctcgtggcctccagctcgagggacagcagtcacgttgactatcagtgaagtccaggcagaggacgaggctgacttattacgtgtacaaacagtagacaagtagagtactcgagttgggtgttcggcggagggaccaaggcgtacggaccgtacgtaggtccacggcccgaaggtcctccggcccccttcgg

SEQ ID NO: 201861 - DNA, 520 bp, Homo sapiens
  misc_feature: GYAE6OF02I4NM3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatcccctgagcgattctctggctccagctcgagggcagcagtcacgttgactatcagtgaagtccaggcagaggacgaggctgactattactgtacaaacagtagactaggtagagtactcgtagttgggtgttcgggcggagggaccgaaggctaggacccgtccgtaggtccacggcccgaaggcctccgcccccgtccgg

SEQ ID NO: 201862 - DNA, 518 bp, Homo sapiens
  misc_feature: GYAE6OF02GRM7Z.21.46.E02.1.454.CMB.1.raw
  modified_base (417)..(417): a, c, t, g, unknown or other
  misc_feature (417)..(417): n is a, c, g, or t
  modified_base (453)..(453): a, c, t, g, unknown or other
  misc_feature (453)..(453): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctcgtggctccagctcgagggacagcagtcacgttgactatcagtgaagtccaggcagaggacgaggctgactattactgtacaaacngtaagacagtagaggtactcgagttgggtgttcggnggaacgggaccaaggctacggaccgttaccgtaggtacacgtacccgaaggcctcgccccctcgg

SEQ ID NO: 201863 - DNA, 497 bp, Homo sapiens
  misc_feature: GYAE6OF02G8TEW.21.46.E02.1.454.CMB.1.raw
  modified_base (312)..(312): a, c, t, g, unknown or other
  misc_feature (312)..(312): n is a, c, g, or t
  modified_base (434)..(434): a, c, t, g, unknown or other
  misc_feature (434)..(434): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtcaggcagaggacgaggctgactattactgtacaaacagtagacagtagagtactnagttgggtgttcggcggaggaccaaggctgaccgtctaggtcacgccaaggctcgcccctcgg

SEQ ID NO: 201864 - DNA, 467 bp, Homo sapiens
  misc_feature: GYAE6OF02GT5Q7.21.46.E02.1.454.CMB.1.raw
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (420)..(421): a, c, t, g, unknown or other
  misc_feature (420)..(421): n is a, c, g, or t
  modified_base (424)..(425): a, c, t, g, unknown or other
  misc_feature (424)..(425): n is a, c, g, or t
  modified_base (427)..(428): a, c, t, g, unknown or other
  misc_feature (427)..(428): n is a, c, g, or t
  modified_base (432)..(467): a, c, t, g, unknown or other
  misc_feature (432)..(467): n is a, c, g, or t
tcagtcgtcgctcgcacgaccggtgctcgatttagactcatctacaggggaaaggggctggtctgggtctcacggattaaaactgacgggactaccacaaactacgcggactccgtgaagggccggttcaccatctccagagacaacgccaagagcacgtctctatctgcaaatgaacagtctgagagtcgaggacatggctgtatattactgtgcaggagaaagggctggatggttattattccgtggggccaggggaaccctggtaaccgtctcctcagcctccaccaagggcccatcggtcttccccctggcgccccngctccaggngcacgtccgagagcacagcggccctgggctgccgtgtcaaggactacttcccgagtcgacgactgagcgggctggcaaggcgcactaggnnganngnngtannnnnnnnnnnnnnnnnnnnnnnnnnnnnnnnnnnn

SEQ ID NO: 201865 - DNA, 549 bp, Homo sapiens
  misc_feature: GYAE6OF02H8EH0.21.46.E02.1.454.CMB.1.raw
  modified_base (317)..(317): a, c, t, g, unknown or other
  misc_feature (317)..(317): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgacttattggtaccaacagaagccaggccacggcccctgtgttagtgatatataaagacactgagagccctnagagactcccgtgagcgattctctggctccagtctcgagggacagcagtcacgttgactanctagtnaacgtcaggacaggacggacgaggctagacttaattacgtagtaccaaacagtagactagtaagacgtaactgtagttggggtgttacgggacggtaacgggaccgaaagcgtacggtaccgtaccgtaggtcaacgacccgaacggctaccgtcccccgtacgg

SEQ ID NO: 201866 - DNA, 532 bp, Homo sapiens
  misc_feature: GYAE6OF02IMWO9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagactccctgagcgattctctggctccagctcagggacagcagtcacgttgactatcagtgaagtccgaggcagaggacgaggctagactattactgacaaacagtagacagtagagtactcgagttgggtgttacgggcggtagggacccgaagtccgtacggacccgttaccgtagggtcaacggtcccgaaggtcctaccggcccccgtacgg

SEQ ID NO: 201867 - DNA, 524 bp, Homo sapiens
  misc_feature: GYAE6OF02JAYYU.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggattgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagaggtactcgagttgggtgttcgggcgggagggacccgaaggtcctcggaccgttccgtaggtcacggaccccgaagggtcctcggtcccccgtcggg

SEQ ID NO: 201868 - DNA, 508 bp, Homo sapiens
  misc_feature: GYAE6OF02GLHDG.21.46.E02.1.454.CMB.1.raw
  modified_base (388)..(388): a, c, t, g, unknown or other
  misc_feature (388)..(388): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtcaggcagnggacgaggctgactattactgtacaaanagtagacagtagagtactnagttgggtgttcggcggagggaccgaaggtctagacccgtcgtaggtacagcccgaaggctcgccccgtccgg

SEQ ID NO: 201869 - DNA, 528 bp, Homo sapiens
  misc_feature: GYAE6OF02FQKLE.21.46.E02.1.454.CMB.1.raw
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
  modified_base (427)..(427): a, c, t, g, unknown or other
  misc_feature (427)..(427): n is a, c, g, or t
  modified_base (450)..(450): a, c, t, g, unknown or other
  misc_feature (450)..(450): n is a, c, g, or t
tcagtcgtcgctcgcacgaccggtgctcgatttagactcatctacaggggaaagggggtgggtccaggaggcagaactctgggtgtctcaccatggcctggatccctctacttctccccctcctcactctctgcactaggctctgaggtcctcctatgagtactgacacagccaccctcggtgtcagtgtccccaggacagacgggccaggatcacctgctctgcagatggactgccaaagaatatgcttatggtaccaacagaanccaaggccaggcccctgtcgttagtgactatataaagacactgagaggccctnagagatccctgagcgattcnctggcctcagctcagggacagcagtcacgttgactatcagtgaagtccagacagaggacgaggtctagacttattactgtacaaacgngtaagacagtaagaggttaactntaagttgggtagttcggaggagggacgaaggctggaaccgtacgtaggtcgagacccgaaggccgtcgccccgttcgg

SEQ ID NO: 201870 - DNA, 670 bp, Homo sapiens
  misc_feature: GYAE6OF02F3LCH.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccctgtgttagtgatatataaagacactgagagccctanagagactcctgagcgtattctctggctccagctcgacggggacaacgacgtacgtacgtacgtacgtactacgtagtagtaacggtacgtacggacgacggaaggacgggaaggtacggacgtacgtaactttaacgttacgtactaaaccgaagtaaggtaacgaacggtaaggtaaacgggtaacgttaaccgtaacgtttaggggtttacgggttacggggttaccggggtacggggtaaccggaacggtaacggttaccggtaacccgggttaaccccgttaccgggtttaacgtaccggtacccggtaaccgggacccggttcccggtacccccggtccccggttaaccccgg

SEQ ID NO: 201871 - DNA, 500 bp, Homo sapiens
  misc_feature: GYAE6OF02JCZB5.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcgagggacagcagtcagttgactatcagtgaagtcaggcagaggacgaggctgactattactgtacaaacagtagactagtagaggtactctagttgggtgttcggaggagggaccgaagctgaccgtcgtagcgagcccgagcgtcgcccctcgg

SEQ ID NO: 201872 - DNA, 515 bp, Homo sapiens
  misc_feature: GYAE6OF02GBP4H.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggccaggcccctgtgttagtgatatataaagacactgagaggccctnagagatccctgagcgattctctgctccagctcagggacagcagtcacgttgactatcagtgagtccaggcagaggacgaggctgacttattactgtacaaactagtaagacaggtagaggtactatagttgggtgttcggcggagggaccgaaggcgtagacccgtcgtaggtcgacgccgaaggcctcgcccccgtcgg

SEQ ID NO: 201873 - DNA, 513 bp, Homo sapiens
  misc_feature: GYAE6OF02IVW30.21.46.E02.1.454.CMB.1.raw
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (418)..(418): a, c, t, g, unknown or other
  misc_feature (418)..(418): n is a, c, g, or t
  modified_base (447)..(447): a, c, t, g, unknown or other
  misc_feature (447)..(447): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgatatataaagacatgagacggccctnagagatccctgagcgattctctggcctcagctcgagggacngcagtcacgttgactatcagtgaagtccaggcagaggacgaggctgactattactgtacaaacngtagacagtagagttactcgagttgggtnttcgggaggacggaccgaaggtctagacccgtcgttaggccacgcccgaggcctccggcccctcgg

SEQ ID NO: 201874 - DNA, 504 bp, Homo sapiens
  misc_feature: GYAE6OF02I0LDA.21.46.E02.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtaggggtccgaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctnagagatccctagagcgattctctggctccagctcagggacagcagtcacgttgactatcagtgaagtccaggcgagaggacgaggctagactattactgacaaacgagtagacgaagtaggagtactcagttgggtgtcggcggaggacgaagctgaaccgtcgtagcagaccaggctacgcccgtcg

SEQ ID NO: 201875 - DNA, 514 bp, Homo sapiens
  misc_feature: GYAE6OF02HL82L.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatcccctgagcgattctctggctccagctcagggacagcagtcacgttgactatcagtgaacgtccaggcaggaggacgaggctagacttattactgtacaaagagtagaacagtaagagtactcgtagttgggtgtcgggcggaggaccgaagcgtgaccgtcgtaggtcacggcccaaggcctcgccccgtcgg

SEQ ID NO: 201876 - DNA, 509 bp, Homo sapiens
  misc_feature: GYAE6OF02IVW04.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctgagcgattctctggcctccagctcagggacagcagtcacgttgactatcagtgaagtccaggcagaggacgaggctgactattactgtacaaacagtagacagtagagtactctagttgggtgttcggcggagggaccgaagctaggaccgtcgtaggtcacggacccgaaggctcgccccgtcgg

SEQ ID NO: 201877 - DNA, 523 bp, Homo sapiens
  misc_feature: GYAE6OF02HL0WV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctcagagatccctgagcgattctctggctccagctcgagggacagcagtcacgttgactatcagtgaagtccaggcaggaggacgaggctgacttattactgtaccaaagagtaagacagtaagaggttactcgtagttgggtgttcgggacgggtagggaccgaaggccgtggaccgtccgtaggtccacgcccgaaggcctcgccccctcgg

SEQ ID NO: 201878 - DNA, 547 bp, Homo sapiens
  misc_feature: GYAE6OF02G5IJN.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatataataaagacactgagaggccctcagagatccctagagacgattctctggctccagctcgaggacagcagtacacgttgactatcaagtgaagtccaggcagaggacgaggctagacttatactagtacaaacgagtaagacgagtagaagttactcgtagttgggtgttcgggacgggtagggaacccgtaaggccgtacggtacccgtaccgtaggtacacggacccgaacgggccttaccggcccccgttacgg

SEQ ID NO: 201879 - DNA, 633 bp, Homo sapiens
  misc_feature: GYAE6OF02I7ZFD.21.46.E02.1.454.CMB.1.raw
  modified_base (157)..(159): a, c, t, g, unknown or other
  misc_feature (157)..(159): n is a, c, g, or t
  modified_base (161)..(161): a, c, t, g, unknown or other
  misc_feature (161)..(161): n is a, c, g, or t
  modified_base (163)..(164): a, c, t, g, unknown or other
  misc_feature (163)..(164): n is a, c, g, or t
  modified_base (167)..(167): a, c, t, g, unknown or other
  misc_feature (167)..(167): n is a, c, g, or t
  modified_base (169)..(169): a, c, t, g, unknown or other
  misc_feature (169)..(169): n is a, c, g, or t
  modified_base (171)..(173): a, c, t, g, unknown or other
  misc_feature (171)..(173): n is a, c, g, or t
  modified_base (175)..(175): a, c, t, g, unknown or other
  misc_feature (175)..(175): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcgtctctactgacgcggctggcaaggcgcatagnnntnanngcncngnnntncagcagcgcagntcactnctgncagntgctgacaaganantntatagtacacagagacgacgacgacgccgtcgtcgtagtagtactataataagtacgtacgtacgacgacgtaccgtacgacgacgtacgtaccgtacgacgtacgtacgttacgtacgtcgtcgtacgtacgtcgtacgacggacgacgacgtacgtacgtacgtacgtacgtacgtacgtacgtacgtacgtacgacgtacgacggacggacgtacggtacgtacgtaacgttacgttacgttacgtaacgtaacgtaacgtaacgtaacgtaacggtaacggtacgttaacgttacgttacggttacgggttacggttacgggtacggtaacggtaacggtaacggtacgtacggtaccgtacgtacggtacgtaccggtaccggtaccggtaccgtacccgtacccgtaccg

SEQ ID NO: 201880 - DNA, 246 bp, Homo sapiens; identical to SEQ ID NO: 200672
  misc_feature: GYAE6OF02FGORG.21.46.E02.1.454.CMB.1.raw
  modified_base (243)..(246): a, c, t, g, unknown or other
  misc_feature (243)..(246): n is a, c, g, or t

SEQ ID NO: 201881 - DNA, 533 bp, Homo sapiens
  misc_feature: GYAE6OF02H28UQ.21.46.E02.1.454.CMB.1.raw
  modified_base (319)..(319): a, c, t, g, unknown or other
  misc_feature (319)..(319): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaatatgacttattggtaccaacagaagccaggccaggccccctgtcgttagtgatataattaaagacactgagaggccctnagagatccctgagcgattctctggctccagctcgagggacagcagtcacgttgactatcagtagaacgtcaggcaggaggagaggctgacttatactgacaaangtaagactagtagagtactcgagttgggtgttcgggcggaacgggaccgaagccgtggacccgttccgtaggttccgacggacccgaaggctaccggcccccgttaccgg

SEQ ID NO: 201882 - DNA, 518 bp, Homo sapiens
  misc_feature: GYAE6OF02I8514.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaaccaacagaagccaggccaggcccctgtgttagtgatatataaagacactgagacggccctacagagatccctgagcgattctctggctccagctcgacgggacagcagtcacgttgactatcagtgaagtccgagacgagaggacgaggctagactattactgtacaaacagtacgacagtagagtactgtagttggtgtacggcggaggaccgaaggtcgtacgaccgtcgtaggcgacgacccgaggcctccgaccccgtcgg

SEQ ID NO: 201883 - DNA, 496 bp, Homo sapiens
  misc_feature: GYAE6OF02HTMUJ.21.46.E02.1.454.CMB.1.raw
  modified_base (438)..(438): a, c, t, g, unknown or other
  misc_feature (438)..(438): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggccctcagagatccctgagcgattctctggctccagctcgagggacagcagtcacgttgactatcagtgaagtccaggcaggaggagaggctgacttattactgtacaaacagtagacgagtagagtactnagttgggtgtggnggaggacgaagctagaccgtcaggtcagccgaagctcgccctcgg

SEQ ID NO: 201884 - DNA, 515 bp, Homo sapiens
  misc_feature: GYAE6OF02H3SS7.21.46.E02.1.454.CMB.1.raw
  modified_base (459)..(459): a, c, t, g, unknown or other
  misc_feature (459)..(459): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctcagagatccctgagcgattctctggcctccagctcgagggacagcagtcacgttgactatcagtgaagtccaggcaggaggacgaggctgacttattacgtgtacaaacagtaagacagtaagagtactcgagtttgggtgttcggngggacgggacgaaggcgtgaccgtccgtaggtcacggcccaaggctcgcccctcgg

SEQ ID NO: 201885 - DNA, 245 bp, Homo sapiens; identical to SEQ ID NO: 200686
  misc_feature: GYAE6OF02HRQBN.21.46.E02.1.454.CMB.1.raw
  modified_base (243)..(245): a, c, t, g, unknown or other
  misc_feature (243)..(245): n is a, c, g, or t

SEQ ID NO: 201886 - DNA, 502 bp, Homo sapiens
  misc_feature: GYAE6OF02G2R37.21.46.E02.1.454.CMB.1.raw
  modified_base (436)..(436): a, c, t, g, unknown or other
  misc_feature (436)..(436): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaaagacactgagaggccctcagagatccctgagcgattctctggctccagctcagggacagcagtcacgttgactatcagtgaagtccaggcagaggacgaggctgactattactgtcaaacagtagacagtagagttactnattgggtgttcggcggagggaccgaaggctggaccgtctaggtcagcccaaggctcgccccctcgg

SEQ ID NO: 201887 - DNA, 800 bp, Homo sapiens
  misc_feature: GYAE6OF02IGEJU.21.46.E02.1.454.CMB.1.raw
tcagtcgtcgctcgcacgaccggtgctcgatttagactcatctacagggaaagggggtgggtccaggaggcagaactcgtgggtgtctcaccagtcggcctggactccctctacttcctcccctcctcactctctgcacgagctctggacggccctctagtgagctgaccacgacgccctacccgtcgggtgtcaggttccgaccccgaaggacacggaccggaccgaaggacttaccgaccgttcggccttcgtcggacgaagtagttacgggacctacggaaccaaaaagtaaattgtcgtacttttacgttacggtaaccaaacgaagaacgaccgacggtaccgaccggtccccgttaggttaggttaaggttagaattaagttaaacgttaaaacggacctaacgtaggaacggaccggtcccctagaagacggtaccctcccgtaggacgacgttactttccgtacgtcggacccttaccgagtccgtacgggaacgggaactacggaccggtacgttaccggtaacgttacgtaacttacgtacgtagggtaacgtaaccggtacggaacggacgaacgggacgggaacgggacggtacgtacgtaactttacgttaacgtacgtaaacaaacgtaagtaacgaacgtaagtaacgggtaacgttactacggttaaggtttcggggttagggtttaccgggacggacgggtaaccgtaaggtccgtacggtaccgttaccggtacggtaccgaccggacccggtaacgggtccctacccggtccccgttacgg

SEQ ID NO: 201888 - DNA, 530 bp, Homo sapiens
  misc_feature: GYAE6OF02G07X7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcgagagatcccctagacgcgtattctctggctccagctcgagggacagcagtcacgttgactatcagtgaagtccaggcagaggacgaggctgactattactgtacaacagtaagacagtagagtactgagttgggtgttcggacgggagggtaccgtaaggttacgaccggtccgtaggtcgacggtcccgaaggtccgtcgtcccccgtggtacccg

SEQ ID NO: 201889 - DNA, 249 bp, Homo sapiens
  misc_feature: GYAE6OF02FSW1Z.21.46.E02.1.454.CMB.1.raw
  modified_base (243)..(249): a, c, t, g, unknown or other
  misc_feature (243)..(249): n is a, c, g, or t
tcagtcgtcgctcgcacgaccggtgctcgatttagactcatctacagggaaagggactggagtggttattattcctggggccagggaaccctggtaaccgtctcctcagcatccaccaagggcccatcggtcttcccctggcgccctgctccaggagcacctccgagagcacagcggccctgggctgcctggtcaaggactacttcccgagcgacgactgagcgggctggcaaggcgcatagnnnnnnn

SEQ ID NO: 201890 - DNA, 516 bp, Homo sapiens
  misc_feature: GYAE6OF02FMN0E.21.46.E02.1.454.CMB.1.raw
  modified_base (425)..(425): a, c, t, g, unknown or other
  misc_feature (425)..(425): n is a, c, g, or t
  modified_base (463)..(463): a, c, t, g, unknown or other
  misc_feature (463)..(463): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggttgtcagtgtccccaggacagacggccaggatcacctgctctgcagatggactgccaaagaaatatgcttattggtaccaacagaagccaggccaggccccctgtgttagtgatatataaaagacactgagaggccctcagagatcccctgagcgattctctggctccagctcagggacagcagtcacgttgactatcagtgaagtccaggccaggaggacgaggctaggacttattactggtacaaanagtagacagtagaggtactcgtagttgggtgtttcggnggagggacaaggctggaccgtctaggtcacggccgaaggcgtcgccccgtcgg

SEQ ID NO: 201891 - DNA, 600 bp, Homo sapiens
  misc_feature: GYAE6OF02H10CR.21.46.E02.1.454.CMB.1.raw
  modified_base (314)..(314): a, c, t, g, unknown or other
  misc_feature (314)..(314): n is a, c, g, or t
  modified_base (366)..(366): a, c, t, g, unknown or other
  misc_feature (366)..(366): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagcaggccaggcccctgtgttagtgatataataaagacactgagacggccctanagagactccctgacgcgtattcctctggctccgagctacgagggacagaccngtacctacgtttcgacttatacaggttagaacgttccgaaggacgaaggacgggacgaaggtcgttacgtaacttaagtttactagtaacctaaacgagtaacgacgtaagtaaggtaacggttactacgtaggttgggttgttcgggacgggtacggtaccgaaacgcgttacggacccgttacgtacggtccgaaccggtacccgaaggtcctcccggtcccccgttaccgg

SEQ ID NO: 201892 - DNA, 533 bp, Homo sapiens
  misc_feature: GYAE6OF02HHQXX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatcccctgagcgattctctggctccagctcagggacagcagtcagttgactatcagtgaagtccaggcagaggacgaggctgactattactgtacaacagtagacagtagaggtaactcgtattgggtgttcgggcgggtagggacccgtaaggcctacggacccgttaccgtaggtccgacggaccccgaaggccgtcggccccccgttaccggg

SEQ ID NO: 201893 - DNA, 522 bp, Homo sapiens
  misc_feature: GYAE6OF02GK8GF.21.46.E02.1.454.CMB.1.raw
  modified_base (321)..(321): a, c, t, g, unknown or other
  misc_feature (321)..(321): n is a, c, g, or t
  modified_base (466)..(466): a, c, t, g, unknown or other
  misc_feature (466)..(466): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtcgttagtgatatataaagacactgagaggccctcgagagntcccctgagcgtattctctaggctccagctcagggacagcagtcacgttgactatcagtgaagtcaggcagaggacgaggctagacttaattacgtagtacaaacagtaagacaagtagacggtactgtagttgggtgtacgggnggagggaacgagtcgagtaccgtcgtaggcacgaccgaaggtcgcgtccccgtcgg

SEQ ID NO: 201894 - DNA, 515 bp, Homo sapiens
  misc_feature: GYAE6OF02FSBV7.21.46.E02.1.454.CMB.1.raw
  modified_base (314)..(314): a, c, t, g, unknown or other
  misc_feature (314)..(314): n is a, c, g, or t
  modified_base (372)..(372): a, c, t, g, unknown or other
  misc_feature (372)..(372): n is a, c, g, or t
  modified_base (461)..(461): a, c, t, g, unknown or other
  misc_feature (461)..(461): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtcgttagtgatatataaagacactgagaggccctnagagatcccctgagcgattctctggctccagctcagggacagcagtcacgttgactancagtgaagtccaggcagaggacgaggctgacttatactgtacaaacagtaagactaagtagaaggttactcgtaagttgggtgttcggngggaggaccaaggcctggaccgtcgtaggtcacgcccgaaggctcgcccctcgg

SEQ ID NO: 201895 - DNA, 492 bp, Homo sapiens
  misc_feature: GYAE6OF02HZN4H.21.46.E02.1.454.CMB.1.raw
  modified_base (373)..(373): a, c, t, g, unknown or other
  misc_feature (373)..(373): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaaacagaagccaggccaggcccctgtgttagtgatatataaagacactgagaggccctcagagatccctgagcgattctctggctccagctcagggacagcagtcacgttgactatnagtgaagtcaggcagaggacgagctgactattactgtacaaanagtagacagtagagtactcagttgggngttcggcggaggacaagctgaccgtcaggtcagccaggctcgccctcgg

SEQ ID NO: 201896 - DNA, 550 bp, Homo sapiens
  misc_feature: GYAE6OF02IWSZ5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaaagacactgagtaggccctacagagatccctgagcgattctctggctccagctcgagggacaggcagtctacgttgactatacagtagaacgtccgaggcaagacggagaggctagtactattaactgtaacaaacgagtaacgacaaggtagtaagtactcgagttcgggtagttcgggacggacgggaaccgaaggactacggaccgtaccgtacggtacgacgcccgaacggcctaccggcccccgtacgg

SEQ ID NO: 201897 - DNA, 514 bp, Homo sapiens
  misc_feature: GYAE6OF02HMONF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgacttattactgtacaaacagtagacagtagaggtactcgtagttgggtgttcggcgggagggaccgaaggctggacccgtcgtaggtcacggacccaaggctcgcccccgtcgg

SEQ ID NO: 201898 - DNA, 687 bp, Homo sapiens
  misc_feature: GYAE6OF02H66LR.21.46.E02.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgtacttattacggtaccaacagaagccaggccagcccctgtgttagtgatataataaagacatgagacgccctnaagagactcccgtagacgcgtacttcctcgtacggccttaccgagcgtacgacgggaactacgccgaagtacctacggttacgaaccttacgtaccgaaggttacgtaaacggtccgaagggtaccgaagggaacggaacggaaggtaccgttacgtaaacttaacgtttaacgtacgtaaccaaaacgttaacgtaaggtaacgtaaaggtaaggtaaacgggtttacttaacgtaggtttacggggttacggttacgggaccggggtaacgggtaccggaaacggttccggttacgggaaccccgtttaccggtaacgggtaccgaacggaccccgtaacgggtcccttacccggacccccgttaccgg

SEQ ID NO: 201899 - DNA, 527 bp, Homo sapiens
  misc_feature: GYAE6OF02I4E1R.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgtacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcaggaggacgaggctgactattactgtacaaacagtagaacagtaagagtactactagttgggtgttacgggcgggagggacgaacgtctacggaccgtccgtaggtccgaacgacccgaagccgtcgcccccgtggtaccc

SEQ ID NO: 201900 - DNA, 545 bp, Homo sapiens
  misc_feature: GYAE6OF02I078F.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagagccaggccaggcccctgtgttagtgatatataaagacactgagaggccctcagagatccctgagcgtattctctggctccgagctcgagggacagcagtcacgttgactatcagtgaagtcgaggcagaggacgagctgacttattactgtacaacgagtagacgtagtagtagttactagtagtttgggtacgttcgggacgggacgggtaccgaaggtccgtacggtacccgttaccgtaggtaccgaccggacccgtaacgggccttcccggcccccgttcgg

SEQ ID NO: 201901 - DNA, 530 bp, Homo sapiens
  misc_feature: GYAE6OF02IJ9TY.21.46.E02.1.454.CMB.1.raw
  modified_base (313)..(313): a, c, t, g, unknown or other
  misc_feature (313)..(313): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaaccaacagaagccaggccaggcccctgtgttagtgatatataaagacactgagagccctnagagatcccgtgacgcgattctcgtcggctccagctacgagggacagcacgtctacgttgactatcagtgaagtcaggcagaggacgagctagactattactgtacaanagtagacagtagagtactcgtagttgggtagttcgggacgggacgggaccgaagccgtacgacccgttccgtaaggtccacggacccgaacggcctccgccccgtcgg

SEQ ID NO: 201902 - DNA, 573 bp, Homo sapiens
  misc_feature: GYAE6OF02ICE7V.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgacttattggtaccaacagaagccaggccaggccccctgtgttagtgatatataaagacactgagaggccctcagagaatccctgagcgattctctgggctccagctcagggacagcagtcacgttgactatcagtagaagtccaggcaaggaggacgaggctgaacttaattactggtacaaacgagtacgaacgagtaaggtacggtactacgtagttgggtcggttacggtcggggaagggtacccgaaaggtccgttacggaacccgttacccttaagggtccgaacggaccccgtaagggcccgttacggtccccccgttaccggg

SEQ ID NO: 201903 - DNA, 664 bp, Homo sapiens
  misc_feature: GYAE6OF02I4I4B.21.46.E02.1.454.CMB.1.raw
  modified_base (229)..(229): a, c, t, g, unknown or other
  misc_feature (229)..(229): n is a, c, g, or t
  modified_base (260)..(260): a, c, t, g, unknown or other
  misc_feature (260)..(260): n is a, c, g, or t
  modified_base (611)..(612): a, c, t, g, unknown or other
  misc_feature (611)..(612): n is a, c, g, or t
tcagtcgtcgctcgcacgaccggtgctcgatttagactcatctacagggaaaggggtggggtccaggaggccagaactctgggtgtctcgacctatggcctgggatccctctacttctcccctacctcactctctgcacaggcttcgtgaggcctcctagttcgagtctgactacagccaccctggtgtcaggtgtcccaggacagatcggccgagggactcgaccgtngctcgtagcagactcgactagacaagaactntcgtcgtactacgtacaacagagcacggccacggtcctaggtcgtagtacgtaataactaacgtaacgacgacgtacggacgtacggaccgtacgacgtacgtacgtaccgtagtacgtacgtacgttacgtacgtacggtacgttacgtacgtcgtacgtacggtactacggtacgtacggtacgtacgttacgtactacgtacgtacgtacgtaacgtaccgaaggacgaacggacggaacgtacgtacgtacgtacgtacgtaacgtaacgtaacgtaaacgtaacgtaacgtaacgtaacggtaacgtacggtacgtacggtaggttacgggtacggttacggtacnnggtacggtacgtacgtacgtacgtacgtacgtacggtacgtacgtacgtacg

SEQ ID NO: 201904 - DNA, 508 bp, Homo sapiens
  misc_feature: GYAE6OF02IV9FP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatgggactgaccaaagaatatgcttattggtaccaacagaagccaggccaggcccctgtgttagtgatatataaagacactgagaggccctcagagatccctgagcgattctctaggctcagctcagggacagcagtcacgttgactatcagtgaagtccaggcagaggacgaggctgactattactgtacaaacagtagacagtagagtactcagttgggtcgttcggcggagggaccaaggtcctggaccgtcgtaggtcaggcccaagggctcggcccctcgg

SEQ ID NO: 201905 - DNA, 719 bp, Homo sapiens
  misc_feature: GYAE6OF02IWLDX.21.46.E02.1.454.CMB.1.raw
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
tcagtcgtcgctcgcacgaccggtgctcgatttagactcatctacagggaaaggggtgggtccaggaggcagaactcctgggtgttctcacctatggtcctggatccctctacttctccccctcctcactctctgcacaggctctgaggcctcctatgtagctgacactagccaccctggtgtcagtgtccccaggacagacggccaggagtcacctgctctgcgagatggacctgccaaagaatngcttattggtaccaacagaagccaggtccacggccctgtgttagtgatatataaagacacgtgagacggtccctnaacgatactcccgtgacgtcgtaacttcctcttcggtcctaccaggtccttaccggaacggggtaaccacggccgtaacggttccgtaaccggttttcgaacccgttaacttacggaacggttaggtaaaccgttaccccgaagggtaccgtaagggtacgggtaaccggagggtaccgttagtaaacctttaagtttaaccgtacggttaaccgtaaaaccgtaggttaaacggacgtaacgggtaaggtaacggttaaccttcggtaaagttttcgggggtacgtttacggggacgggtaacggggaccctaagggtcccttcgggtaacccgttaccggttacggtacgtaaccggtacccgtaagggtccccgttaccggccccccgttacggg

SEQ ID NO: 201906 - DNA, 544 bp, Homo sapiens
  misc_feature: GYAE6OF02I2OUE.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaaagacactgagaggccctnagagatccctgagcgattctctggctccagctcagggacagcagtcacgttgactatcagtgaagtcaggcagaggacgaggctgaactattactgtacaaactagtaagacaagtagaagggttactcgtaaattggggtagttaccgggcgggaagggacccaaggcttaggaacccgttaccgtaaggtcgacggtccccgaagggtccttccgcccccgttaccggg

SEQ ID NO: 201907 - DNA, 502 bp, Homo sapiens
  misc_feature: GYAE6OF02JSIAB.21.46.E02.1.454.CMB.1.raw
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccacagaagccaggccaggcccctgtgttacgtgatatataaagacactgagaggaccctnagagatccgtagagcgattcnctgctcagctcagggacagcagtcacgtgactatcgagtgaagtcagtcagaggacgagctagactattactgtacaacagtanacgagtagagtactntagttggtgttacggcggtaggaccagtctgaccgttacgaggtacaggacccgaggctcgccccgtcgg

SEQ ID NO: 201908 - DNA, 534 bp, Homo sapiens
  misc_feature: GYAE6OF02HTP45.21.46.E02.1.454.CMB.1.raw
  modified_base (288)..(288): a, c, t, g, unknown or other
  misc_feature (288)..(288): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgacttattggtaccaacagaagccaggccaggcccctgtgttagngatataataaagacactgagacggccctgaagacgatcccctgacgcgtattctcgtgctccagctcgagggacagcagtcacgttgactatcagtagacgtcaggcaggagacgaggctgattattactgtacaacgtagtagacgagtagaagttacttcgagttgggtgttcgggacggacggacgaagtcgtacgaccgttaccgtaggtacgacgaccgacggtcctccggacccctacgg

SEQ ID NO: 201909 - DNA, 508 bp, Homo sapiens
  misc_feature: GYAE6OF02GME54.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctnagagatcccctgagcgattctctggctccagctcagggacagcagtcacgttgactatcagtgaagtccaggcaggaggacgaggctgactattactgtacaaacagtagacagtagaggtactcagttgggtgttcgggcggagggaccgaaggctggaccgtccgaggtcagcccaaggctcgcccccttcgg

SEQ ID NO: 201910 - DNA, 549 bp, Homo sapiens
  misc_feature: GYAE6OF02H9TS1.21.46.E02.1.454.CMB.1.raw
  modified_base (334)..(334): a, c, t, g, unknown or other
  misc_feature (334)..(334): n is a, c, g, or t
  modified_base (355)..(355): a, c, t, g, unknown or other
  misc_feature (355)..(355): n is a, c, g, or t
  modified_base (429)..(429): a, c, t, g, unknown or other
  misc_feature (429)..(429): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagattcattgaccaaaagatatacttgttgttccagcagaagtcaggccaggcccctgtactggtcatccatgagccagtcgacgacacgtccgggatcccgtgagagacttcnctcgcctcagtctcgaggacngtcgccctacttgaacttatcgaggtcggggcccagggtcggacgagtagaagtctagactacttatttgtacncacagactagtagtggtcagtcgaggggttatcgggacggacgggacgtaggttcgaccgttcgttggtacacggcccgaaggcgtccggccccgtcggtccacgttccgtcgttccccg

SEQ ID NO: 201911 - DNA, 503 bp, Homo sapiens
  misc_feature: GYAE6OF02FKZEI.21.46.E02.1.454.CMB.1.raw
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggcaggaggacgaggctgactattactgtacaaacagtanacagtagagtactcattgggtgttcggcggaggacgaaggctagaccgtcgtaggtcacgcccgaaggctcgccccgtcgg

SEQ ID NO: 201912 - DNA, 536 bp, Homo sapiens
  misc_feature: GYAE6OF02F8SSM.21.46.E02.1.454.CMB.1.raw
  modified_base (371)..(371): a, c, t, g, unknown or other
  misc_feature (371)..(371): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatcccctgagcgattctctggctccagctcagggacagcagtcacgttgactancagtgaagtccaggcagaggacgaggctgactattactgtacaaacagtaagacaagtagaggttactacgtagttgggtagttcgggacgggagggaccgaaggcgttacggacccgttacgtaggtacacggtacccgaaggtccgtcggcccccgttaccgg

SEQ ID NO: 201913 - DNA, 523 bp, Homo sapiens
  misc_feature: GYAE6OF02IJ69X.21.46.E02.1.454.CMB.1.raw
  modified_base (241)..(241): a, c, t, g, unknown or other
  misc_feature (241)..(241): n is a, c, g, or t
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaatntgcttattggtacaacagaagccaggccaggcccctgtgttagtgatatataaagacactgaagaggccctnagagatccctgagcgattctctggctccagctacgagggacagcagtcacgttgactatacagtagaagtccaggcagaggacgaggctagacttattacgtgacaaagagtaagacagtagaaggtactacgagttgggtgttcgggcgggagggaccgaaggtctcggtaccgtcgtaggtcgacgcccgaaggcctcgccccgtcgg

SEQ ID NO: 201914 - DNA, 652 bp, Homo sapiens
  misc_feature: GYAE6OF02JAOFE.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggacctgaccaaaagaatatgcttattggtaaccaacagaagccaaggccaggcccctgtgttagtgatatataaagacactgagacggccctagaagagactcccgtgacgcgtattctcgtggcttccagctacgagggactacgctaagtcgtacgttcgactacgtacgaagtacggaacgtccgaaggtacgaacggaacgggaacgacggtacgtagaacttaacgttacgtacgtacctaaaacgtacgttaagaacgtaaggtaacggtaacggttaaccttagtaacggtttggggttacgttaccggggacgggtaacgggtaacccggaaggttaccgtacggtaacccggttaccgtaagggttaccgacgggtaaccccgtaacgggtcccgtaccggtaccccccgtttacggg

SEQ ID NO: 201915 - DNA, 537 bp, Homo sapiens
  misc_feature: GYAE6OF02FS2DV.21.46.E02.1.454.CMB.1.raw
  modified_base (318)..(318): a, c, t, g, unknown or other
  misc_feature (318)..(318): n is a, c, g, or t
  modified_base (339)..(339): a, c, t, g, unknown or other
  misc_feature (339)..(339): n is a, c, g, or t
  modified_base (444)..(444): a, c, t, g, unknown or other
  misc_feature (444)..(444): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgactacagccaccctcggtgtcagtgtccccaggacagacggccagggatcacctgctctgcagatggactgccaaagaaatatgcttattggtaccaactagaagccaaggccaggccccctgtgttagtgagtatataaaggacactgagaggccctnagagatcccctgagcgattcnctggctccagcttcagggacagcagtcacgttgactagtcagtgaagtccaggcagaggacgaggctagactattactgtacaaacagtagacagtagagtactnagtttgggtgttcgggcggacgggaccgtaaggcttacgacccggttcctaggtccacggtaccccgaagggtctaccggccccgttaccggg

SEQ ID NO: 201916 - DNA, 519 bp, Homo sapiens
  misc_feature: GYAE6OF02HLPY9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgacttattggtaccaacagaagccaggccaggcccctgtgttagtgatatataaagacactgagaggccctcagagatccctgagcgattctctggctccagctcgagggacagcagtcacgttgactatcagtgaagtccaggcagaggacgaggctgactattactgtacaaagagtaagacaagtagaggtactgagttgggtagttcggacggagggaccgaagcgtacggaccgtccgtaggtacacgacccgaaggcctccgcccctacgg

SEQ ID NO: 201917 - DNA, 525 bp, Homo sapiens
  misc_feature: GYAE6OF02F8SQJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacaaacggccaggatcacctgctctggagattcattgaccaaaagatatacttgttggttccagcagaagtcaggccaggccccctgtactggtcatccatgaggccagtcgacgacactccgggatccctgagagattctctgcctcagctcagggacaggtcgccaccttgactatcgaggtcgggcccaggtggacgagtgaagctgactactagttgtacgcaccagacagtagtggtacagtcgaggggttatcgggcggaggaccaagttcgaccgtcgtggtcacgcccgaaggcctcgccccgtggtccactcctcgtccctccc

SEQ ID NO: 201918 - DNA, 602 bp, Homo sapiens
  misc_feature: GYAE6OF02JA0NE.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttagttcggtaaccaacgagaagccaggcccaggccccctggtagttagtggtatataataaagacaactgaagacggccctagaagagactcccgtagacgcgtatttcctcgtcggcctaccgagctcgaagggacagcagtcgacgttgactatcagtgaagtaccaggcaaggacggagaggctaggtacttaagttaacgttgtaacaaaacgaggtacgaacgtaggtaacgaggttactcgtaaggttcgggtaggttccggacgggtaggtaaccgaaggcttacggacccggttacgtaacgggtccgaccggacccgtaaggccggttaccgacccccgttaccggg

SEQ ID NO: 201919 - DNA, 512 bp, Homo sapiens
  misc_feature: GYAE6OF02INKDK.21.46.E02.1.454.CMB.1.raw
  modified_base (315)..(315): a, c, t, g, unknown or other
  misc_feature (315)..(315): n is a, c, g, or t
  modified_base (340)..(340): a, c, t, g, unknown or other
  misc_feature (340)..(340): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaaccaacagaagccaggccaggcccctgtgttagtgatatataaagacactgagacggccctnagagactccctgacgcgtattcctntcggctccagctcgaggacagcagtcacgttgactatacagtgaacgtcaggcaggaggacgaggctagacttagttactgtacaaactagtaagactagtagaggtactnagttgggtgttcggnggaggacagtctcgaccgtcgtagtcacgcccgagctcgccctcgg

SEQ ID NO: 201920 - DNA, 506 bp, Homo sapiens
  misc_feature: GYAE6OF02GQ2OK.21.46.E02.1.454.CMB.1.raw
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (453)..(453): a, c, t, g, unknown or other
  misc_feature (453)..(453): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaaagacactgagaggccctnagagatccctgagcgattcnctggctccagctcagggacagcagtcacgttgactatcagtgaagtccaggcagaggacgaggctgactattactgtacaaacagtagacagtagaggtactctagttgggtgttcggnggagggaccaaggctagaccgtccgtaggtcacgcccaaggctcgcccctcgg

SEQ ID NO: 201921 - DNA, 548 bp, Homo sapiens
  misc_feature: GYAE6OF02JBZ4D.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaaccaacagaagccaggccaggcccctgtgttagtgatatataaagacactgagacggccctanagagatccctagagcgattctctggctcagctgaggacagcagtcacgttgactatcagtagaacgtccaggacaggaaggacgaggctagaactattactgtacaaacgagtaacacgagtaacgagttactctagttgggtgttaccgggaggtacgggaccgaaggtccgtaggtacccgttacgtaggtaccgacggacccgaaggtccgtaccggcccccgttaccgg

SEQ ID NO: 201922 - DNA, 504 bp, Homo sapiens
  misc_feature: GYAE6OF02F8GMV.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaaggccaggcccctgtgttagtgatatataaagacactgagaggccctnagagatccctgagcgattctctggctccagctcagggacagcagtcacgttgactatcagtgaagtccaggcagaggacgaggctgacttattactgtacaaacagtagacagtagaggtactcagttgggtgttcggcggagggaccaagctggaccgtctaggtcagcccgaaggcgtcgccccgtcgg

SEQ ID NO: 201923 - DNA, 526 bp, Homo sapiens
  misc_feature: GYAE6OF02IK04H.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagacggccctnagagatccctgagcgattctctggcctccagctcgagggacagcagtcacgttgactatacagtagaagtccaggcgagaggacgaggctagactattactgtacaagagtagacagtagagtactgtagttgggtgttcggcggagggaccgaaggtcgtacggtaccgtaccgtaggtcgacggcccgaaggccgtccgcccccgtcgg

SEQ ID NO: 201924 - DNA, 506 bp, Homo sapiens
  misc_feature: GYAE6OF02HJT5I.21.46.E02.1.454.CMB.1.raw
  modified_base (344)..(344): a, c, t, g, unknown or other
  misc_feature (344)..(344): n is a, c, g, or t
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctnagggacagcagtcacgttgactatcagtgaagtcaggcagaggacgaggctagacttattactgtacaaanagtagacagtagagtactgagttgggcgttggacggagggaccaaggctggaacccgtcgtaggtcacggcccaaggctcggccccctcgg

SEQ ID NO: 201925 - DNA, 500 bp, Homo sapiens
  misc_feature: GYAE6OF02FR31M.21.46.E02.1.454.CMB.1.raw
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagagacgaggctgactattactgtacaaacagtagacagtagagtactnagttgggtgttcggngagggacaaggctgaccgtctaggtcagcccgaaggcctacgcccctacgg

SEQ ID NO: 201926 - DNA, 503 bp, Homo sapiens
  misc_feature: GYAE6OF02F977E.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagaggtactcagttgggtgttcggcggaggaccgaaggctgaccgtcgtaggtcacggcccaaggctcgcccctcgg

SEQ ID NO: 201927 - DNA, 577 bp, Homo sapiens
  misc_feature: GYAE6OF02IJBF8.21.46.E02.1.454.CMB.1.raw
  modified_base (259)..(259): a, c, t, g, unknown or other
  misc_feature (259)..(259): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgacttattggtaccaanagaagccaggccaggcccctgtgttagtgatatataaagacactgagnggccctnagagtactccctgagcgattctcgtggctccagctacgagggacagcagtcacgttgactatcagtagacgtcaggcaggaggacgaggctagacttattacgtagtacaaagtagtaagaacgaggtaagaggttactacgtaggttcgggtaggttcgggacgggtaacgggaccgaaggtaccgtacggtaacccggttccggttaacggtccgaaccggtacccgacgggtacccgtcccggtaccccccgttaccggg

SEQ ID NO: 201928 - DNA, 539 bp, Homo sapiens
  misc_feature: GYAE6OF02F04Y1.21.46.E02.1.454.CMB.1.raw
  modified_base (417)..(417): a, c, t, g, unknown or other
  misc_feature (417)..(417): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagagccctcagagatccctgagcgattctctggctccagctcgagggacagcagtcacgttgactatcagtgaagtcaggcagaggacgaggctgactattactgtacaaacngtaagacgaagtagaagttactcagtttgggtagtttcgggcgggacgggaccgtaaggcgtacggtaacccgttcgtaaggtccgacggacccgaaggcccgtacgccccccgttaccggg

SEQ ID NO: 201929 - DNA, 245 bp, Homo sapiens
  misc_feature: GYAE6OF02GAOEM.21.46.E02.1.454.CMB.1.raw
  modified_base (244)..(245): a, c, t, g, unknown or other
  misc_feature (244)..(245): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttccctcgtctctactgagcgggctggcaaggcgcatagnn

SEQ ID NO: 201930 - DNA, 505 bp, Homo sapiens
  misc_feature: GYAE6OF02F7IP7.21.46.E02.1.454.CMB.1.raw
  modified_base (313)..(313): a, c, t, g, unknown or other
  misc_feature (313)..(313): n is a, c, g, or t
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctgagcgattctctggctccagctcagggacagcagtcacgttgactatcagtgaagtccaggcagaggacgaggctgactattactgtacaaacagtagacagtagagtactcagttgggtgttcggngggaggaccgaagcgtagaccgtctaggtcagacccgaaggcctcgccccgtcgg

SEQ ID NO: 201931 - DNA, 503 bp, Homo sapiens
  misc_feature: GYAE6OF02HE5TA.21.46.E02.1.454.CMB.1.raw
  modified_base (312)..(312): a, c, t, g, unknown or other
  misc_feature (312)..(312): n is a, c, g, or t
  modified_base (417)..(417): a, c, t, g, unknown or other
  misc_feature (417)..(417): n is a, c, g, or t
  modified_base (436)..(436): a, c, t, g, unknown or other
  misc_feature (436)..(436): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtccaggcagaggacgaggctgactattactgtacaaacngtagacagtagaggtactnagttgggtgttcgggcggaggaccaaggctggaccgtcctaggtcagcccgaaggctcgcccctcgg

SEQ ID NO: 201932 - DNA, 511 bp, Homo sapiens
  misc_feature: GYAE6OF02FRHGA.21.46.E02.1.454.CMB.1.raw
  modified_base (257)..(257): a, c, t, g, unknown or other
  misc_feature (257)..(257): n is a, c, g, or t
  modified_base (315)..(315): a, c, t, g, unknown or other
  misc_feature (315)..(315): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaanagaagccaggccaaggccccctgtcgttagtgatatataaagacactgagaggccctnagagatccctgagcgattctctggctccagctcagggacagcagtcacgttgactatcagtgaagtccaggcagaggacgaggctgactatactgtacaaacagtagacagtagaggttacncattgggtgttcggnggacggaccgaaggctagaccgtcgtaggtcacggcccgaaggcctacgccccctacgg

SEQ ID NO: 201933 - DNA, 247 bp, Homo sapiens
  misc_feature: GYAE6OF02GBXX5.21.46.E02.1.454.CMB.1.raw
  modified_base (244)..(247): a, c, t, g, unknown or other
  misc_feature (244)..(247): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacgactgagcgggctggcaaggcgcatagnnnn

SEQ ID NO: 201934 - DNA, 285 bp, Homo sapiens
  misc_feature: GYAE6OF02FPKFK.21.46.E02.1.454.CMB.1.raw
  modified_base (248)..(285): a, c, t, g, unknown or other
  misc_feature (248)..(285): n is a, c, g, or t
tcagtcgtcgctcgcacgaccggtgctcgatttagactcatctacagggaaagggactggtagtggttattattcctggggccagggaaccctggtaaccgtctcctcagcctccaccaagggcccatcggtcttccccctggcgccctgctccaggagcacctccgagagcaacagccggaccctgggctgcctggtcaaggactacttccctcgtctctactgagcgggctggcaaggcgcatagnnnnnnnnnnnnnnnnnnnnnnnnnnnnnnnnnnnnnn

SEQ ID NO: 201935 - DNA, 531 bp, Homo sapiens
  misc_feature: GYAE6OF02H6ZCO.21.46.E02.1.454.CMB.1.raw
  modified_base (320)..(320): a, c, t, g, unknown or other
  misc_feature (320)..(320): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgactttattggtaccaacagaagccaggccaggccccctgtgttagtgatatataaaagacatgagaggccctanagagactccctgagcgattctctcggctccagctcgagggacagcagtcacgttagactatcagtgaagtcaggcaaggaggacgaggctagactattactgtacaaacaggtanacgtagtaagaggttactacgagtttagggtgtacggacgggagggaccaaggcgtcggaccgtcctaggcaggcccaagggctccgccccgtcgg

SEQ ID NO: 201936 - DNA, 585 bp, Homo sapiens
  misc_feature: GYAE6OF02JK9O7.21.46.E02.1.454.CMB.1.raw
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
  modified_base (354)..(354): a, c, t, g, unknown or other
  misc_feature (354)..(354): n is a, c, g, or t
tcagtcgtcgctcgcacgaccggtgctcgatttagactcatctacagggaaagggggtaggggtccgaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgacagatggactgaccaaagaaattgcttattggtaccaanagaagccaggccaggcccctgtgttagtgatatataaaagcactgagaggccctnagagntccctgagcgattcnctggctcagctcagggacngcagtcacgttgactatcagtagagtccaggcagaggacgaggctgaactacttacgttagaccaaagagtacgaacgtagtaagaacgggttactacgtagtttcggggtagtttaccgggcgggtaaggggacccgtaaaggcccgttaggtaacccccgggttacttacggggtacctaccgggtaccccgaaagggtccccgttaccggtcccccccgttacccggg

SEQ ID NO: 201937 - DNA, 535 bp, Homo sapiens
  misc_feature: GYAE6OF02HG5C2.21.46.E02.1.454.CMB.1.raw
  modified_base (319)..(319): a, c, t, g, unknown or other
  misc_feature (319)..(319): n is a, c, g, or t
  modified_base (428)..(428): a, c, t, g, unknown or other
  misc_feature (428)..(428): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggccccctgtgttagtgatatataaagacactgagaggccctcaganatccctgagcgattctctggctccgagctcgagggacagcagtccagttcgactatcagttgaagtccaggcaggagggagaggctagacttattactagtacaaacgngtaagacagtagaggtactcgtagttgggtgttcgggcggaagggaccaaggccgtagtacccgtcgtacggtcaccggacccgaaggccttaccgcccccgtacgg

SEQ ID NO: 201938 - DNA, 515 bp, Homo sapiens
  misc_feature: GYAE6OF02FLVK1.21.46.E02.1.454.CMB.1.raw
  modified_base (313)..(313): a, c, t, g, unknown or other
  misc_feature (313)..(313): n is a, c, g, or t
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatcccctgagcgattctctggctccagctcagggacagcagtcacgttgactatcagtgaagtccaggcagaggacgaggctagactattactgtacaaacagtagacagtaagaggtactnagttgggtgttcggcgggaggaccaaggctcggacccgtccgtaggtcgacgacccgaaggcctcggccccctcgg

SEQ ID NO: 201939 - DNA, 523 bp, Homo sapiens
  misc_feature: GYAE6OF02GOEWP.21.46.E02.1.454.CMB.1.raw
  modified_base (260)..(260): a, c, t, g, unknown or other
  misc_feature (260)..(260): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgctttattggtaccaanagaagccaggccaggcccctgtgttagtgatatataaagacactgagaggccctcagagatcccctgagcgattctctggctccagctcgagggacagcagtcacgttgactatcagtgaagtccaggcagaggacgaggctgactattactgtacaaactgtaagacagtagacggttactgagttgggtcgttcggacgggaggaccgtaaggctcggaccgtccgtaggtcacggaccgaacggcgtccgcccccgtcgg

SEQ ID NO: 201940 - DNA, 533 bp, Homo sapiens
  misc_feature: GYAE6OF02H59QA.21.46.E02.1.454.CMB.1.raw
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
  modified_base (396)..(396): a, c, t, g, unknown or other
  misc_feature (396)..(396): n is a, c, g, or t
  modified_base (417)..(417): a, c, t, g, unknown or other
  misc_feature (417)..(417): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaatatgcttaattggtaccaaacagaagccaggccaggccccctgtgttagngatataataaagacactgagaggccctnagagactccctgagcgattctctggctccagctcgagggacagcagtcacgttgactatcagtgaacgtcaggcaagnggacgaggctagactattacngtacaagagtagacagtagaggtactgtagttagggtgttcgggacggtagggaaccgtaggaccgtagacccgttacgtaggtcacgacccgaaggtcctccggcccccgttcgg

SEQ ID NO: 201941 - DNA, 799 bp, Homo sapiens
  misc_feature: GYAE6OF02I1OZ1.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacaggacggccaggatccacctgctctgcagatggactgaccaaaagaaatntgcttattgaaccaacagaacgccaggccgacggcccctgtgttagtgatataataaagacacgtgaggacggccctacgagacactccctaggacgcgtacttccgtcgtacggtccttacccgagtctaccggaacggggtacacggtaccgtaacgttccgtaacgtttacgtaacctttaacgttaccgaagggttaaacggtaacggttaccccgaaggggtacccgaaagggaaaccggggaccgggtaaggggtaccgttaacggttaaccgttttaaacgttttaaacccgttcggttaaaaccgtaaaaacgtaacgggttaaaacggtaaccgtaaaggggttaacggttaaacggggtttaaccttaaccggttagggttttacggggttaccggggtttacggggacccggggtaacggggtaaccgaaccggtttccggtaacccgggtaacccggtttaccggttaacgggttacccgtaaccgggacccccgggtaaacgggtccccggttaccccggacccccccggtttaccggg

SEQ ID NO: 201942 - DNA, 519 bp, Homo sapiens
  misc_feature: GYAE6OF02H4YLV.21.46.E02.1.454.CMB.1.raw
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctcagagatccctgagcgattctctggctccagctcagggacagcagtcacgttgactatcagtgaagtcaggcagaggacgaggctgactattacngtacaaanagtagacagtagagtactnagttgggtgttcggcgggagggaccaaggtcctaggacccgttccgtagggtctacggcccgaagggtctaccggccccgttccgg

SEQ ID NO: 201943 - DNA, 506 bp, Homo sapiens
  misc_feature: GYAE6OF02GW2JI.21.46.E02.1.454.CMB.1.raw
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccatggcccggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactattactgtcaaacagtagacagtagaggtactcagttgggtgttcggnggagggaccgagcgtgaccgtccgtaggtcaggcccaaggctcgccccctggtccg

SEQ ID NO: 201944 - DNA, 508 bp, Homo sapiens
  misc_feature: GYAE6OF02H0E8S.21.46.E02.1.454.CMB.1.raw
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatntgcttattggtaccaacagaagccaggccaggcccctgtgttacgtgatatataaagacactgagaggccctnagagatccctggagcgattctacgtggctccagctcgagggacagcagtcacgttgactatcagtgaagtcaggcgagaggacgaggctagacttattatgacaaangtagacagtagagtactcgagttgggtgtcggnggacgggacaagcgtcgaccgtcgtaggtcacgccaacggctcgcccctacgg

SEQ ID NO: 201945 - DNA, 525 bp, Homo sapiens
  misc_feature: GYAE6OF02HH35N.21.46.E02.1.454.CMB.1.raw
  modified_base (314)..(314): a, c, t, g, unknown or other
  misc_feature (314)..(314): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagacggccctnagagactccctgagcgattctctggctccagctcgagggacagcagtcacgttgactatcagtgaagtccaggcagaggacgaggctagacttattactgtacaaagngtaagacagtagaggttactgtagttgggtgttcgggcggtagggaccgaaggccgtaggaccgtaccgtaggtcacggcccgaaggcctccggccccgtcgg

SEQ ID NO: 201946 - DNA, 559 bp, Homo sapiens
  misc_feature: GYAE6OF02HNJDO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagagccctcagagatccctgagcgattctctggctccagctcagggacagcagtcacgttgactatcagtgaagtccgaggcagaggacgaggctagacttatactgtacaaacagtaagacgaagtagtaaggttactacgtaagttggggttagttcgggacgggtaacgggaaccgaaggtccgtaggtacccggtaccgtaacgggtccgaacggaccccgtaacgggccgttccggccccccgttaccgg

SEQ ID NO: 201947 - DNA, 672 bp, Homo sapiens
  misc_feature: GYAE6OF02HT95H.21.46.E02.1.454.CMB.1.raw
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtgtccccaggacagacggccaggatcacctgctctgcagatggactgaccaaaagaatatgacttattaggtaccaacagaagccaggccaggcccctgtgttagtgatatataaagacactgagaggccctnaganatccctgacgcgattctcgtggcctccgagctacgacgggacacgcagtcacgtttgactatcgagtagaacgtccgaaggcgaaggacgggacgacggacgtacggaacttaacgttaacgtgtaaacctaaaccgtaaggttaacggaaccgtaaggttaaacggtaacgggttaacctacggttaacggttttagggggttacggtttaccggggaccgggggtaagggaaccccgtaaagggttacccgttacgggtaacccccggttacccggttaagggttaccgtaacccggtaaccccggaaacgggtccctttaccccgggtaccccccccgtttacccggg

SEQ ID NO: 201948 - DNA, 502 bp, Homo sapiens
  misc_feature: GYAE6OF02GB9KO.21.46.E02.1.454.CMB.1.raw
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatcccctgagcgattctctggctccagctcagggacagcagtcacgttgactatcagtgaagtccaggcaggaggacgaggctagactattactgtacaaacagtagacagtaagaggtacntattgggtgttcggcggaggaccgaagctgaccgtctaggtcagcccaaggctcgcccctcgg

SEQ ID NO: 201949 - DNA, 549 bp, Homo sapiens
  misc_feature: GYAE6OF02HN47V.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgctttattggtaccaaacagaagccaggccaggcccctgtgttagtgatatataaagacactgagaggccctcagagactccctagacgcgattctctggcttccagctcgagggacagcagtcacgttgactatcagtagacgtcaggcaggaggacgaggctgacttattactgtacaaacagtaagacagtaagaggttactacgtagttgggtgttcgggacgggagggaccgaaggccgttaggacccgttaccgtaggtaccgacggacccgaagggtccctacggccccccgttaccgg

SEQ ID NO: 201950 - DNA, 588 bp, Homo sapiens
  misc_feature: GYAE6OF02IKR5K.21.46.E02.1.454.CMB.1.raw
  modified_base (322)..(322): a, c, t, g, unknown or other
  misc_feature (322)..(322): n is a, c, g, or t
  modified_base (456)..(456): a, c, t, g, unknown or other
  misc_feature (456)..(456): n is a, c, g, or t
  modified_base (574)..(574): a, c, t, g, unknown or other
  misc_feature (574)..(574): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagcaggccaggcccctgtgttagtgatatataaagacactgagaggcctcagagacttcccngagcgtattctctcggctccgagctacgacgggacagcgagtctaacgttcgactatacgaagtcgtaacgtccgacggactacgggaaggaacggaggacgtagtaacttaacgttacgtgtaacgaaaacgnggtaacgtaaccgaggtaaacggtacggtacgtacgtaagttacggggttgtttaccgggcggtaacgggaccgtaaggcgtacggaccgttccgaggtccgacgaccgtaaggtccncggaccccgttcgg

SEQ ID NO: 201951 - DNA, 527 bp, Homo sapiens
  misc_feature: GYAE6OF02IP0DU.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaacgccaggccaggcccctgtgttagtgatatataaagacactgagacggccctanagagactccctgagcgatttctctggcctccagctcgagggacagcagtcacgttgactatcagtgaacgtcaggcagaggacgaggctagactattactgtacaacagtagacagtagagtactgtagttgggtgttcggcggacgggacaaggtccgtacggaccgttacgtaggtccaggcccgaaggcctccggaccccctcgg

SEQ ID NO: 201952 - DNA, 527 bp, Homo sapiens
  misc_feature: GYAE6OF02F2XTC.21.46.E02.1.454.CMB.1.raw
  modified_base (312)..(312): a, c, t, g, unknown or other
  misc_feature (312)..(312): n is a, c, g, or t
  modified_base (439)..(439): a, c, t, g, unknown or other
  misc_feature (439)..(439): n is a, c, g, or t
  modified_base (455)..(455): a, c, t, g, unknown or other
  misc_feature (455)..(455): n is a, c, g, or t
tcagtcgtcgctcgcacgaccggtgctcgatttagactcatctacagggaaagggggtgggtccaggaggcagaactctgggtgtctcaccatggtctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtcaggcagaggacgaggctagactattactgtacaaacgagtagacgagtagaggttactntagttgggtgttcggnggtacgggaccgaaggccgtaggaccgttccgtaggtccgacggacccgaaggtcctacgcccccgttccgg

SEQ ID NO: 201953 - DNA, 544 bp, Homo sapiens
  misc_feature: GYAE6OF02HFC7M.21.46.E02.1.454.CMB.1.raw
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagaggccctagagagactcccgtagagacgatttctctggcctccagctacgagggacagcagtcacgttgactatacagtagaagtccaggcaggaggacgaggctagactatactgtacaanagtaganagtagagttactctagttgggtgttcgggacggtaaggtaccgaaggtccgtacggaccggttccgtaaggtccgagtacccgaacggtcctaccggcccccgtacggg

SEQ ID NO: 201954 - DNA, 548 bp, Homo sapiens
  misc_feature: GYAE6OF02GDPL3.21.46.E02.1.454.CMB.1.raw
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaanagaagccaggccaggcccctgtgttagtgatatataaagacactgagaggccctnagagactccctgagcgtattctcgtggcctccagctcgacgggacagcagtctacgttgactatcagtgaagtccaggcaggaggacgaggctagaacttattactgtaacaaacgagtaagacgtaagtaagagttactctaagttgggttagttcgggacggagggaccgaaggcgttacggaacccgttcgtaggtcacggcccgaaggtcctacggcccccgttaccgg

SEQ ID NO: 201955 - DNA, 527 bp, Homo sapiens
  misc_feature: GYAE6OF02JD5KD.21.46.E02.1.454.CMB.1.raw
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtcgttagtgatatataaagacactgagaggccctcagagatccctgagcgattctctggctccagctcagggacagcagtcacgttgactatcagtgaagtccaggcaggaggacgaggctgacttagtactgtacaaacagtagacagtaagagtactnagttgggtgttcggcggaggaccgaaaggtctacggaccgtccgtaaggtccgacgcccgaaggtccgtaccggcccccgttacccgg

SEQ ID NO: 201956 - DNA, 581 bp, Homo sapiens
  misc_feature: GYAE6OF02HNYVI.21.46.E02.1.454.CMB.1.raw
tcagtcgtcgctcgcacgaccggtgctcgatttagactcatctacagggaaagggggtgggtccaggaggcagaactctgggtgtctcaccatggcctggacccctctcctgctccccctcctcactttctgcacagtctctgaggcctcctatgagctgacacagcccaccctcggtgtcagtcgtccccaggacaaacggccaggatcacctgctctggagattcattgaccaaaagatatacttgttgttccagcagagtcaggccaggccctgtactggtcatccatgacggccaggtcgacgacaccgtccgggactcccgtgagagtacttctctgccctccagctcgagggacaggtcggcctacttgactatcgaggtcgggcccagggtcggacgtatgaagctagactactattgtacgcacgagacagtagtgtacagtacggaggggttagttcgggacggagggacctaaggttcgtaccgttccgttggtccgacggcccgaagggtcctccggtcccccgttcgggtcctaccgttcccgttaccgttccccctaccccgttcccg

SEQ ID NO: 201957 - DNA, 502 bp, Homo sapiens
  misc_feature: GYAE6OF02G4SUD.21.46.E02.1.454.CMB.1.raw
  modified_base (417)..(417): a, c, t, g, unknown or other
  misc_feature (417)..(417): n is a, c, g, or t
  modified_base (451)..(451): a, c, t, g, unknown or other
  misc_feature (451)..(451): n is a, c, g, or t
  modified_base (482)..(482): a, c, t, g, unknown or other
  misc_feature (482)..(482): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatcccctgagcgattctctggctccagctcagggacagcagtcacgttgactatcagtgaagtccaggcagaggacgaggctgactattactgtcaaacngtagacagtagaggtactcagttgggtgttcggnggagggaccaaggctggaccgtcgtaggtcngcccaaggctcgcccctcgg

SEQ ID NO: 201958 - DNA, 497 bp, Homo sapiens
  misc_feature: GYAE6OF02HLWGL.21.46.E02.1.454.CMB.1.raw
  modified_base (240)..(240): a, c, t, g, unknown or other
  misc_feature (240)..(240): n is a, c, g, or t
  modified_base (314)..(314): a, c, t, g, unknown or other
  misc_feature (314)..(314): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatntgcttattggtaccaacagaagccaggccaggcccctgtgttagtgatatataaaagacactgagacggccctnagagatccctgagcattctctggctcagctcgaggcagcagtcacgttgactatcagtagagtccaggcagaggacgaggctagactatacngtacaanagtagacagtagagtcatagttggtgtcggcggaggacaagctaggaccgtcgtaggtcgacgccaaggcgtccgccccgtcgg

SEQ ID NO: 201959 - DNA, 510 bp, Homo sapiens
  misc_feature: GYAE6OF02FV7MB.21.46.E02.1.454.CMB.1.raw
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtnttagtgatatataaaagacactgagaggccctnagagatcccctgagcgattctctggctccagctcagggacaggcagtcacgttgactatcagtgaagtccaggcagaggacgaaggctagactaattactgtacaaaacagtaagacagtaagaggtactcattagggtgttacggcggagggaccaagcgtgaccgtctaggcagcccaaggctacgcccctcgg

SEQ ID NO: 201960 - DNA, 551 bp, Homo sapiens
  misc_feature: GYAE6OF02GSPH9.21.46.E02.1.454.CMB.1.raw
  modified_base (316)..(316): a, c, t, g, unknown or other
  misc_feature (316)..(316): n is a, c, g, or t
  modified_base (408)..(408): a, c, t, g, unknown or other
  misc_feature (408)..(408): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgcttattggtaccaacagaagccaggccaggcccctgtgttagtgatataataaagacactgagagccctnagagactccctagagcgtattctctggcctcacgctacgagggacagcacgtcacgttgactatcgagtagagtaccgaggcaggaggacgnggctagactattactagtacaagagtacacgtagtagtaagtactacgtagttgggtgttagggccggagggtaaccaaggaccgtacggaccgttacgtacgggtacgacgtacccgaagggtcgtcccggtccccgtccgg

SEQ ID NO: 201961 - DNA, 600 bp, Homo sapiens
  misc_feature: GYAE6OF02F3ULU.21.46.E02.1.454.CMB.1.raw
  modified_base (244)..(244): a, c, t, g, unknown or other
  misc_feature (244)..(244): n is a, c, g, or t
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatgactgaccaaaagaaatangcttagttggtaaccaacagaacgccaggccaggccctgtgttagngatatataaagacactgagagccctanaagacgactcccgagagcgtacttctcgtggcctacccgagtcctacgaagggacaggccgaagttccgaacgtttcgaacgttaactacgaagtacgtaacgtaccgaagggaccgaaggaacggaacggacggcgtagtacttaacttacgtagtaacaaacgtagtaagacgtaagtagagtactatagttggtagttcggacggaggaccgtaagacgtacggtaccgttaccgtacggtcgtaccggacccgtaacggccgtaccgtcccccgtacgg

SEQ ID NO: 201962 - DNA, 637 bp, Homo sapiens
  misc_feature: GYAE6OF02JJZOM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtccagtcgtccccaggacagacggccaggatccacctgctctgcagatggactgaccaaaagaaatatgtcttattcggtaaccaacgagaacgccaggccaggcccctgtgttagtgatatataaagactacgtgagacggccctacagagactccctaggacgcgtacttcgtacgtcggcctaccgagcctacgaacgggaccacgacctacggtactacggttagaacttagtacgtagtacggtaacggtaccgaaggaccgaaggaacggtaccggagggtaccgttacggaacttaagttactagtaacaaacgtagtaacgaacgtagtaacggtagtactacgtagttacggggtgttacgggacgggtaacggaccgaaaggtctacgggtacccgttacgtacgggtacaccggaccgtaacgggcccgttaccgaccccgttaccgg

SEQ ID NO: 201963 - DNA, 532 bp, Homo sapiens
  misc_feature: GYAE6OF02IA34G.21.46.E02.1.454.CMB.1.raw
  modified_base (466)..(466): a, c, t, g, unknown or other
  misc_feature (466)..(466): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaagacactagagacggccctcagagactccctagagcgtattcctctggcctccagctacgagggacagcagtcacgttgactatcagtgaagtcgaggcaggacggagaggctagactattacgtgtacaacagtagacagtagagtacttacgagttgggtgttcggnggacggaccgaaggccgtaggtaccgttaccgtaggtcgtacgacccgaggcctccgcccctacgg

SEQ ID NO: 201964 - DNA, 521 bp, Homo sapiens
  misc_feature: GYAE6OF02H784N.21.46.E02.1.454.CMB.1.raw
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgctttattggtaccaaacagaagccaggccaggcccctgtgttagtgataataataaaagacactgagaggccctcagagatccctgagcgattctctggctccagctcagggacaagcagtcacgttgactatcagtgaaagtccagcagagagagctgactattangtacaaanagtaaganaagtagaggtaactctaagttgggtgttcggcggtagggacccgaaggcctagacccgttactaggtcaggccctaaggctaccgcccctacgg

SEQ ID NO: 201965 - DNA, 511 bp, Homo sapiens
  misc_feature: GYAE6OF02GGDJG.21.46.E02.1.454.CMB.1.raw
  modified_base (333)..(333): a, c, t, g, unknown or other
  misc_feature (333)..(333): n is a, c, g, or t
  modified_base (437)..(437): a, c, t, g, unknown or other
  misc_feature (437)..(437): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatcccctgagcgattcnctggctccagctcagggacagcagtcacgttgactatcagtgaagtccaggcagaggacgaggttgacttattactgtacaaacagtagacagtagaggtactnagttggtagttcggcgggagggaccaaggctagaccgtcgtaggtcagcccaaggcctcggccccctggtaccc

SEQ ID NO: 201966 - DNA, 527 bp, Homo sapiens
  misc_feature: GYAE6OF02JKREO.21.46.E02.1.454.CMB.1.raw
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (417)..(417): a, c, t, g, unknown or other
  misc_feature (417)..(417): n is a, c, g, or t
tcagtcgtcgctcgcacgaccggtgctcgatttagactcatctacagggaaagggggtgggtccgaggaggcagaactctgggtgtctcaccatggcctggatccctctacttctccccctcctccactttctgcacagtctctgaggcctcctatgagctgacacagccaccctcggtgtcagtcgtccccaggacaaacggccaggatcacctgctctggagatttcattgaccaaaaagatatacttgttggtccagcagaagtcaaggccaggcccctgactgtcatccatgaggccagtcgacgactactcgggaatccctgacgagattcctctgcctccagctnagggnagtggcctactgactatcagtgggccagtggacgatgagctgactacattgttaagcgacngacagtagtgtacgatcgaggggtaattcggcgagggaccaagttgaccgtcttacggtcaagccgtaagcttacgccccgtacggtcaactcgtcgttcccgccctccg

SEQ ID NO: 201967 - DNA, 526 bp, Homo sapiens
  misc_feature: GYAE6OF02JC3VN.21.46.E02.1.454.CMB.1.raw
  modified_base (313)..(313): a, c, t, g, unknown or other
  misc_feature (313)..(313): n is a, c, g, or t
  modified_base (426)..(426): a, c, t, g, unknown or other
  misc_feature (426)..(426): n is a, c, g, or t
  modified_base (459)..(459): a, c, t, g, unknown or other
  misc_feature (459)..(459): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtccaggcaggaggacgaggctgacttattactgtaccaaactgtaanacgaagtagagtactcgagttgggtgttcgggnggtagggaccgaaggctacggaccgtcgtaggtccgacggcccgaaggcctaccggcccccgtacgg

SEQ ID NO: 201968 - DNA, 539 bp, Homo sapiens
  misc_feature: GYAE6OF02HNISY.21.46.E02.1.454.CMB.1.raw
  modified_base (440)..(440): a, c, t, g, unknown or other
  misc_feature (440)..(440): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgacttattacggtaaccaaacagaagccaggcccaggcccctgtgttagtgatatataaagacactgagacgccctacgagagactcccgaggacgcgtacttcgtctcggcctccgagctcgaggacagcagtcacgttgactatcgagtagaagtccgaggcagaggacgaggctagacttatactagacaaagngtagacgtagtagtacgtatacgtagtggtgtcggacgggaggaccgtaagctacggtaccgtacgtagcacggaccgacggtctacccgccccgtcgg

SEQ ID NO: 201969 - DNA, 507 bp, Homo sapiens
  misc_feature: GYAE6OF02G6JTS.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttagtgatatataaaagacactgagaggccctcagagatcccctgagcgattctctggctccagctcagggacagcagtcacgttgactatcagtgaagtccaggcaggaggacgaggctagactattactgtacaaacagtagacagtagagtactcagttgggtgttcggcggagggaccaaggctgaccgtccgtaggtcacgccaaggctcgccccctcgg

SEQ ID NO: 201970 - DNA, 554 bp, Homo sapiens
  misc_feature: GYAE6OF02GY11I.21.46.E02.1.454.CMB.1.raw
  modified_base (312)..(312): a, c, t, g, unknown or other
  misc_feature (312)..(312): n is a, c, g, or t
  modified_base (432)..(432): a, c, t, g, unknown or other
  misc_feature (432)..(432): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggacaggcccctgtgttagtgatatataaagacactgagaggccctnagagatccctgagcgtattctctggctccagctcgaggacagcagtcacgttgactatcagtgaacgtccgaagcgaaggaggacgaggctgacttagttacctgtacaaactaggtaanacgtaagtaaggaggttactcgtagtttgggtagtttcgggacgggtagggaaccgaaggtccgtacggaacccgttcgtacggtcaccggacccaagggtccgtaccgcccccgttaccgg

SEQ ID NO: 201971 - DNA, 246 bp, Homo sapiens
  misc_feature: GYAE6OF02FSK03.21.46.E02.1.454.CMB.1.raw
  modified_base (243)..(246): a, c, t, g, unknown or other
  misc_feature (243)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagcggccctgggctgcctggtcaaggactacttccctcgtctctactgagcggctggcaaggcgcatagnnnn

SEQ ID NO: 201972 - DNA, 800 bp, Homo sapiens
  misc_feature: GYAE6OF02FLAWM.21.46.E02.1.454.CMB.1.raw
tcagtcgtcgctcgcacgaccggtgctcgatttagactcatctacagggaaaggggtgggtccaggaggctagaactctgggtgtcttcgtaccgagtggcctggatcctctacttcgtccctcctcactctctcgcacacggctctcgacggcctcctatcgagctgacacagtccaccgtcggtcgtcagtgtcccaggacacgacggccacggactcacctgcttctcgcgagactcggactgaccaaagaaactactgcttagttacggtaccaacacggtaacgccgtaacggaccaaacgggccccttaggttcgtttacgtacgtaacgtaacttaacgtaaaacgacgtaacgttacggaacggaccggtaccccgttacgtaacggtacgtacgttacccgttagtaaacggtacgttaacgtttacgtcggttacggccttaccgaaacggtccgttacgaacggggtactaacggtccgtaacggttccgaacgttcgtaacgttacgtccgtaacggtacggaaacgtaccggaacggtacgaacggacggacggtaggtaccgtacggtaaccttacggttaaccgtacggtaaccgaaaacggtacggtaacgtaacgtaacggttaacggtaacggtttaacgtacttaacgggtttcgggtacgggttacgggacgggtaacgggtaaccgtaaacgggtaccgtacgggtaacccggtttacgtaacgggttaccgaaccgggtacccggtaagggtcccgttaccggtcccccgttaccggg

SEQ ID NO: 201973 - DNA, 526 bp, Homo sapiens
  misc_feature: GYAE6OF02GCQ8G.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagatccctgagcgattctctggctccagctcgagggacagcagtcacgttgactatcagtgaagtccaggcagaggacgaggctagactattactgtacaaagagtagacagttaagaggtactcgaagttgggtgttcggacggagggaccaaggtctaggacccgttcgtacggtacacggacccgaaggccttaccgcccccgtacgg

SEQ ID NO: 201974 - DNA, 567 bp, Homo sapiens
  misc_feature: GYAE6OF02JDCY7.21.46.E02.1.454.CMB.1.raw
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (419)..(419): a, c, t, g, unknown or other
  misc_feature (419)..(419): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacgccaggatcacctgctctgcagatggactgaccaaaagaaatatgcttattggtaccaacagaagccaggccaggcccctgtgttagtgatatataagacactgagaggccctnagagatccctgacgcgattctctggctccagctcgaggacagcagtcacgttnactatcagtgaagtccaggcagaggacgaggctagactatactgtacaaacgngtaagacagtagagttactacgtagttgggtagttccgggacgggtaagggtacccgtaaaggtccgtacggtaacccgttacccgtaagggtaccctaccgggtaacccccgaaagggtccgttacccggccccccgtttacccggg

SEQ ID NO: 201975 - DNA, 527 bp, Homo sapiens
  misc_feature: GYAE6OF02G8UVA.21.46.E02.1.454.CMB.1.raw
  modified_base (421)..(421): a, c, t, g, unknown or other
  misc_feature (421)..(421): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggcaagaggacgaggctgactattactgtacaacagtanacgagtagagtactcgagttgggtgttcggcgggtagggaccaaggtccgtggaacccgttcgtaaggtcacggaccccgaaggcctaccggccccccttaccggg

SEQ ID NO: 201976 - DNA, 521 bp, Homo sapiens
  misc_feature: GYAE6OF02G9FQ4.21.46.E02.1.454.CMB.1.raw
  modified_base (458)..(458): a, c, t, g, unknown or other
  misc_feature (458)..(458): n is a, c, g, or t
tcagtcgtcgctcgcacgaccggtgctcgatttagactcatctacagggaaagggggtgggtccaggaggcagaactcctgggtgtctcaccatggcctggatccctctacttctccccctcctcactctctgcacaggctctgaggcctcctatgagtctgacacagccactctcggtgtcagtgtccccaggacaggacggccagggatccaccgtgctctgcagagtcggactgaccaaagaatatgcttattggtaccaacagtaagcctaaggaccaggccccctgtgttagtgatatataaagacactggagaggccctcgagaggatccctgagcgattctctggctccagtctacagggtacagcacgtcgacgttgacttactcagtgaacgtcaggcagacggagaggctagacttattactgtacaaatagagacagtagagtactnagttggtgtggaggaggacaggtctgaccgtacgtacggtcacggccaggtcgtcgtccccgg

SEQ ID NO: 201977 - DNA, 562 bp, Homo sapiens
  misc_feature: GYAE6OF02IEP44.21.46.E02.1.454.CMB.1.raw
  modified_base (337)..(337): a, c, t, g, unknown or other
  misc_feature (337)..(337): n is a, c, g, or t
  modified_base (550)..(550): a, c, t, g, unknown or other
  misc_feature (550)..(550): n is a, c, g, or t
tcagtcgtcgctcgcacgaccggtgctcgatttagactcatctacagggaaagggggtagggtccgaggaggcgagaactctgggtgtctcaccatggcccggatccctctacttctcccctcctcactctctgcacaggctctgaggcctcctatgagctgacacagccaccctcggtgtcagtgtcccccaggacagacggccaggatcacctgctctgcagatggactgaccaaaagaaatatgctttaattggtaaccaacagaagccaggccaggcccctgtgttagtgaatataataaagaacatacgagacggcctcgagagactcccgngagcgtattctcgtcggcttaccagctcgagggacacgacagtccaacgtttgaactatacacgtagtaacgaccgaggacgaacggagggacggacggtctaggtaacgttaattacgtgtaacgaaactagaacgagagtaagaggtactgtaagttgggtacgttggacggaggaccaggctacgcgtccgtaggcagcccgaagcgtcnccccgttgtacc

SEQ ID NO: 201978 - DNA, 765 bp, Homo sapiens
  misc_feature: GYAE6OF02HMYIB.21.46.E02.1.454.CMB.1.raw
tcagtcgtcgctcgcacgaccggtgctcgatttagactcatctacagggaaaggggttggggtccaggaggtcagaactctgggtgtcgtcaccatggcctggataccctactacttctccccctcctcacgttctcctcgcacaggctcgtcgacggcctcctagtcgagcctgaccacagccaccctcggtgtcgagtcggtcccccaggacaggacggccaggacgtccaccctgcctctcgccagatggactgaccgaaaggaactactagtcttaattggtaaccaacaagaacgcctaggccgacggccccgtagtcgttacgtgacctaaggtaagtaaaacgacaacgttggaagtacgggccccttacgtaacggagaacgttccccggtaggaacgtaccggtaactttacccgtacccgttcgggacctaccgtaggaccctacgaacggggaacctacgtacgaacggttacctaaccggtttaccgaacctttaaactacctaacggttaccggaaacggttacccgaagggaccgtaagggaacggaccggaagggttccgtaccggactttaaacgtacgtacgtaccaaacgtcggttaaagtacctaaggtacggtaaggttacctcggtaacgttcggggttacgttcgggacgggtaacgggtacccgttaaggccgttaccggttacccgttaccgtagggttccacgggtacccggaacggtcccgtaccgcccccggttacgg

SEQ ID NO: 201979 - DNA, 526 bp, Homo sapiens
  misc_feature: GYAE6OF02IE7EO.21.46.E02.1.454.CMB.1.raw
  modified_base (332)..(332): a, c, t, g, unknown or other
  misc_feature (332)..(332): n is a, c, g, or t
  modified_base (342)..(342): a, c, t, g, unknown or other
  misc_feature (342)..(342): n is a, c, g, or t
  modified_base (376)..(376): a, c, t, g, unknown or other
  misc_feature (376)..(376): n is a, c, g, or t
  modified_base (452)..(452): a, c, t, g, unknown or other
  misc_feature (452)..(452): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaatatgcttattggtaccaacagaagccaggccaggcccctgtgttagtgatataataaagacactgagagccctcgagagactcccgtgacgngtaccccttntctggctccagctcgagggacagcagtcacgttnactatcagtgaagtcgaggcaggaggacgaggctagactattacgtgtaacaaacgagtagactagtagagtactntagttgggtgttcgggacggaggacaagcctaggacccgtcgtagcgacggacccgaggcctccgccccgtcgg

SEQ ID NO: 201980 - DNA, 642 bp, Homo sapiens
  misc_feature: GYAE6OF02IKFQ3.21.46.E02.1.454.CMB.1.raw
  modified_base (210)..(210): a, c, t, g, unknown or other
  misc_feature (210)..(210): n is a, c, g, or t
  modified_base (246)..(246): a, c, t, g, unknown or other
  misc_feature (246)..(246): n is a, c, g, or t
  modified_base (319)..(319): a, c, t, g, unknown or other
  misc_feature (319)..(319): n is a, c, g, or t
tcagtcgtcgctcgcacgaccggtgctcgatttagactcatctacaggaaagggggtagggtccgaggaggcgagaactctgggtgtcgtcaccatggcctggatccctctacttcctcccctcctcactctctgcacaggctctgagcctcctatgagctgacacagccaccctcggtgtcagtcgtccccaggacacgacggccaggntcacctgctcgtgcagatggactgaccaaagaaatntgcttagttgtaccaacagaacgcacggcaggcccctgtgtacgtgatatataaagcaactgagacgccctanagagactcccgtaggacgcgtacttccgtacgtcgggtcttacccgacgtctacggacgggtacaacgacgtacgtacgtaacggtttcgaacttacgtaacaaggttacgaaacgtccgtaacggcgaaaggacgggacgaacggtacgtacgaacttattacgtagtacgaaactagtacgaacgaagtagaacgttactacgtagttacgggtaggtttccgggacgggtaacgggaccaagggtccgtacggtaacccggtaccgttagggttaccgaaccgtacccgtaacggacccgtccgggtaccccttaccggg

SEQ ID NO: 201981 - DNA, 545 bp, Homo sapiens
  misc_feature: GYAE6OF02ISAYA.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaagacactgagaggccctanagagactccctgacgcgattctctggcctaccagctcgagggacagcagtccagttgactatacgagtgaacgtccaggacaggacggacgaggctagacttatacctgtaccaaagagtagacagtaagaggttactgtagtttgggtcgttacgggcggtagggaccgaggtccgtaggtacccgttcgtagggtcacggacccgaaggccgtaccgcccccttacgg

SEQ ID NO: 201982 - DNA, 543 bp, Homo sapiens
  misc_feature: GYAE6OF02JGI7J.21.46.E02.1.454.CMB.1.raw
  modified_base (312)..(312): a, c, t, g, unknown or other
  misc_feature (312)..(312): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctnagagatccctgagcgattctctggcctcagctcgagggacagcagtcacgttgactatcagtacgaagtccaggcagaggacgaggctaggacttatacgtgtacaaacngtaagacgaggtagaaggttactacgtagtttggggtcgttacgggcgggaacgggtaccaaggctacgggacccgttcgtacggtcacggacccgaagggtcctaccggcccccgttcgg

SEQ ID NO: 201983 - DNA, 526 bp, Homo sapiens
  misc_feature: GYAE6OF02FYU5L.21.46.E02.1.454.CMB.1.raw
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagatccctgagcgattcnctggctccagctcagggacagcagtcacgttgactatcagtgaagtccagcagaggacgaggctgactattactgtacaaactagtagaactagtaaggagttactcagtttggggtgttcgggcggaggggtaccaaggctacggacccgttcgtagggtccacggacccaaggcctaccggcccccgtacgg

SEQ ID NO: 201984 - DNA, 528 bp, Homo sapiens
  misc_feature: GYAE6OF02JOVNS.21.46.E02.1.454.CMB.1.raw
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
tcagtcgtcgctcgcacgaccggtgctcgatttagactcatctacagggaaagggggtagggtccgaggaggcgagaactctgggtgtctcaccatggcctggatccctctacttctccccctcctccactctctgcacaggctctgaggcctcctatgagctgcacagccaccctcggtgtcagttcgtcccccaggaccagaccggccagggtatcacctgctctgcagatggactgccaaaagaaatntgcttatgtaccaanaganccaggccaggcccctgtgttagtgatatataaagacactaggagacggccctcaganactccctgagcgatttccngttggcctcctagcttgaacgggtaacngntacgtcaagtttcgactaatcagtcgaagtccgtaggacagaggacgacggtactgtactatactganaacaganacagtaggtagtctacnttaggtgttcggngaggacgaagtctgaccgtctaggccagccaaggctcgtccccgtcg

SEQ ID NO: 201985 - DNA, 522 bp, Homo sapiens
  misc_feature: GYAE6OF02FU0ZX.21.46.E02.1.454.CMB.1.raw
  modified_base (372)..(372): a, c, t, g, unknown or other
  misc_feature (372)..(372): n is a, c, g, or t
  modified_base (419)..(419): a, c, t, g, unknown or other
  misc_feature (419)..(419): n is a, c, g, or t
  modified_base (425)..(425): a, c, t, g, unknown or other
  misc_feature (425)..(425): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttagtgatatataaagacactgagaggccctcagagatccctgagcgattctctggctccagctcgagggacagcagtcacgttgactancagtgagtccaggcagaggacgaggctgacttattactgtaccaaangtaganagtagaggttactacgtagttgggtgttcggacgggagggaccgaaggctacggacccgttacgtaggtcacggccctaaggcctcgcccccgtcgg

SEQ ID NO: 201986 - DNA, 541 bp, Homo sapiens
  misc_feature: GYAE6OF02HHUMM.21.46.E02.1.454.CMB.1.raw
  modified_base (416)..(416): a, c, t, g, unknown or other
  misc_feature (416)..(416): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctacgagacgatcccctgagcgatttctctggcctccagctcgagggacagcagtcacgttgactatcagtgaagtccaggcagaggacgaggctagactatacgtntaacaaacagtaagacaagtagagtactactagttagggtgttacgggcgggaagggtaccgaagcgtaggacccgttacgtacggtcgaacggcccgaaggtccgtaccggcccccgttaccgg

SEQ ID NO: 201987 - DNA, 717 bp, Homo sapiens
  misc_feature: GYAE6OF02H06KF.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatangacttagttcggtaccaaacagaacgccgaggccacggcccctgtgttagtgataagtataaagacacgtgagacggccctgaagagactcccgtggacgtcggtactttccgtcgttagggccctacccgaggtcttaccgaacggggaaccaaggtccaacggtacctaaccgggtttacgaaccttaacgtacgtaacggttaggtaaacgtccggaagggtacaacgggacgggaacggaacgggtccgttacggtaaaccgtttaagtttaaccgttacggtaaaccaaaaccgtaaggttaacggaaacgtaaggtaacggtaacgggttaacttaacgtagggtttacggggttggttaaccgggacggggtacgggtaaccgaacgggtccgttacggacccggttacccgtagggttaccaaccgggcccgtaaccgggtccttcccgggaccccccggttaccgg

SEQ ID NO: 201988 - DNA, 520 bp, Homo sapiens
  misc_feature: GYAE6OF02GDWE0.21.46.E02.1.454.CMB.1.raw
  modified_base (370)..(370): a, c, t, g, unknown or other
  misc_feature (370)..(370): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggccccctgtgttagtgatataataaagacactgagacggccctcagagatccctgagcgtattctctggctccagctcgagggacagcagtcacgttnactatcagtagaagtccaggcaggacggacgaggctagacttatactgtacaaacagtagacagtagagtactgtagttggtgttcgggcggacggacgaaggtctacggtaccgtacgtaggtcacgccgaaggctccgccccgtccgg

SEQ ID NO: 201989 - DNA, 506 bp, Homo sapiens
  misc_feature: GYAE6OF02FMLRJ.21.46.E02.1.454.CMB.1.raw
  modified_base (315)..(315): a, c, t, g, unknown or other
  misc_feature (315)..(315): n is a, c, g, or t
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggccccctgtgttagtgatatataaagacactgagaggccctnagagatccctgagcgattctctggctccagctcgagggacagcagtcagttgactatcagtgaagtccaggcagaggacgaggctagactattactgtacaaacagtaganagtagagtactnagttgggtgttggcggagggaccaaggctgaccgtctaggtcgacgcccgaaggcctcgcccctccgg

SEQ ID NO: 201990 - DNA, 644 bp, Homo sapiens
  misc_feature: GYAE6OF02H9ZGT.21.46.E02.1.454.CMB.1.raw
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggaccggccaggatcacctgctctgcagatggactgaccaaagtaaatntgacttagttacggaacaacagaagccagccaggccctgtgttagngatataataagacactgagacgccctnaagagtactccctagacgcgtattcctgtcggcctaccgacgtctacggagggaccacgtacgacgttcgtaccgtttaggtaacctagtcgtaacgggtagtaaacggttaccgaacggacgaggaacggacgaggtccgtagacttagttaacgtgtaacaaacgagttacgagtaaggtaacgtaaggttaacacgttagtttcgggttacgggttccggaggggtaccgggaacgtaacggtaccgtacggtaacccgttaccgtaccggttccgaacggtaccccgtaaaggtcccgttcccgtaaccccccggttccggg

SEQ ID NO: 201991 - DNA, 539 bp, Homo sapiens
  misc_feature: GYAE6OF02H9RCO.21.46.E02.1.454.CMB.1.raw
  modified_base (242)..(242): a, c, t, g, unknown or other
  misc_feature (242)..(242): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcacctgctctgcagatggactgaccaaaagaatntgcttattggtaccaacagaagccaggccaggcccctgtgttagtgataataataaagacactagagaggccctcagagactccctgagcgattctctggctccagctcgagggacagcagtcacgttgactatcagtgaagtcaggcaagaggacgaggctagactattactgtacaaanagtagacagtagagtactcgagttgggtgttcgggacgggacggaccgaaggccgtaggacccgttccgtaagggtccaacggacccgaacgggtcctcccggcccccgttaccgg

SEQ ID NO: 201992 - DNA, 554 bp, Homo sapiens
  misc_feature: GYAE6OF02G51P1.21.46.E02.1.454.CMB.1.raw
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgcttattggtaccaacagaagccaggccaggccccctgtgttagtgatatataaagacactgagaggccctcagagatcccctgagcgattctctggctccgagctcgagggacagcagtcacgttgactatcagtgaagtcaggtcaggaggacgaggctgactattactgtacaaagntaganagtaagaggtactacgtagttgggtagttaccggcgggtacgggaccgaaggaccttacggaacccgttccggtaaggtccgtaaccggcccgtaaagggcccttccggaccccccgttaccggg

SEQ ID NO: 201993 - DNA, 798 bp, Homo sapiens
  misc_feature: GYAE6OF02IJ7SN.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggcagtatggactgacctaaagaatatagtcgttaacttggtaaccaagaagaacgaccgacggccgacggtcccctggtcgttagtagataataagtaaacgacactaggacgacggccctagaagtacgtacgtcccgtagaagtccgtaactttccgtcgtcgggtcccttaccgaacggtaccgtaccggaaacggggtaaccaacggtacgaaccgttaccgtaaccggttagtaacgttacgtaccgaacggttacggaaaacggttcccggaaaggggtaccgaaacgggtaacggggtaaccggtaaccgggaccgtttaggtaaacccgtttaaatttaacccgttaaggtaaaccgaaaacgtaacgggttaaacggtaaccgttaaaggggttaaacggttaacgggtttaaccttacggttacggttttacggggttaacggtttaccggggtaccggggaaacgggttaacccggaacggttacccggtacggtaacccggttaccgtaaccgggtaccgaaccggtaaccccgaacggtcccgttacccggtacccccgttaccggg

SEQ ID NO: 201994 - DNA, 495 bp, Homo sapiens
  misc_feature: GYAE6OF02JVQ0C.21.46.E02.1.454.CMB.1.raw
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
  modified_base (395)..(395): a, c, t, g, unknown or other
  misc_feature (395)..(395): n is a, c, g, or t
  modified_base (441)..(441): a, c, t, g, unknown or other
  misc_feature (441)..(441): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggccccctgtgttagtgatatataaagacactgagaggccctcagagatccctgagcgattcnctggctcagctcaggacagcagtcacgttgactancagtgagtccaggcagagacgaggcngactatactgtcaacagagacagtagagtactcagttggtgtcggnggacggacgaagcgtagaccgtccgtaggtcacgcccaaggctcgccccctcgg

SEQ ID NO: 201995 - DNA, 494 bp, Homo sapiens
  misc_feature: GYAE6OF02ICMQU.21.46.E02.1.454.CMB.1.raw
  modified_base (333)..(333): a, c, t, g, unknown or other
  misc_feature (333)..(333): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (446)..(446): a, c, t, g, unknown or other
  misc_feature (446)..(446): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtacaacagaagccaggccaggcccctgtgttagtgatatataaagacactgagaggccctcaagagatccctgagcgattctcncggctccagctacgagggacagcagtctacgttgatatcagtgaagtccaggcagaggacgaggctgatattangtacaaanagtagacagagagtatcaagttggtgtcggnggaggacaagcgtgaccgtacaggtcacgccaaggctccgcccctcgg

SEQ ID NO: 201996 - DNA, 248 bp, Homo sapiens
  misc_feature: GYAE6OF02GVQ4J.21.46.E02.1.454.CMB.1.raw
  modified_base (243)..(248): a, c, t, g, unknown or other
  misc_feature (243)..(248): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttccctcgtctctactgagcgggctggcaaggcgcatagnnnnnn

SEQ ID NO: 201997 - DNA, 505 bp, Homo sapiens
  misc_feature: GYAE6OF02IO8S0.21.46.E02.1.454.CMB.1.raw
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcaggaggacgaggctgactattacngtacaaatgagacagtagagtacttnagttgggtgttcggcgggaggaccaaggtctggacccgttcgtaggtcacggcccaaggctcgcccctcgg

SEQ ID NO: 201998 - DNA, 596 bp, Homo sapiens
  misc_feature: GYAE6OF02JHIXV.21.46.E02.1.454.CMB.1.raw
  modified_base (334)..(334): a, c, t, g, unknown or other
  misc_feature (334)..(334): n is a, c, g, or t
  modified_base (413)..(413): a, c, t, g, unknown or other
  misc_feature (413)..(413): n is a, c, g, or t
  modified_base (415)..(416): a, c, t, g, unknown or other
  misc_feature (415)..(416): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacagctctgaggcctcctatgagctgacacacgccaccctcggtcgtcagtgtccccaggacagacggccaggatcacctgctctgcagatggactgaccaaaagaaattatgacttattggtaaccaacagaacgccgaggccaaggtcccctgtagttagtgatataataaagacactgagacggcctcagagactcccngacgcgtattctctggcctccagctacgaggacagctagtcacgttcgactatacgagttagaacgtcagtcagcgagngnngaactagttactgacaaacgagtaacgaacgtagtaaaggtacgttacgtacgtaggtttagggtcggtttaccgggacgggacggggtaaccaagggtaccttacgggtaacccgttaccggtaacggttcggaaccggtacccggtaacggcccgttacccgggtacccccttccggg

SEQ ID NO: 201999 - DNA, 522 bp, Homo sapiens
  misc_feature: GYAE6OF02I6EGR.21.46.E02.1.454.CMB.1.raw
  modified_base (323)..(323): a, c, t, g, unknown or other
  misc_feature (323)..(323): n is a, c, g, or t
  modified_base (430)..(430): a, c, t, g, unknown or other
  misc_feature (430)..(430): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgcttattccggtaaccaacagaagccaggccacggcccctgtgttagtgatataataaagacactgagacggccctanagagactccctgagcgattctcgtggctccagctcgagggacagcagtcagttgactatcagtagaagtcgaggcaggaggacgagctagactagttactgacaaangtagacagtagagtactcgtagttgggtgtcgggaggaggacgaaggctcggaccgtcgtaggtcacgacccgaggtcctccgccccgtcgg

SEQ ID NO: 202000 - DNA, 738 bp, Homo sapiens
  misc_feature: GYAE6OF02I068U.21.46.E02.1.454.CMB.1.raw
  modified_base (166)..(166): a, c, t, g, unknown or other
  misc_feature (166)..(166): n is a, c, g, or t
  modified_base (425)..(425): a, c, t, g, unknown or other
  misc_feature (425)..(425): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactttctgcacagtctctgaggcctctctgagcgtcacacacnccgacccctccggtggttcacgtggttcccacccggaacgaaacgaaccggacgaagtacacctacgtcgtccttcggaggaattctacttagtccgaaaacgaaaataattaacttcggttgggtttccgtacacgacgaagtacgtacggaccgaccgacccggtccgttagtacggttcggactacctacgagtacgggaccacgtacgacggacaaccgtccggtaccggaccttccgaggacgagttctcgtcnccgcctacgcgtcacggtacggacgtcggccgtaccctagtacgtactactcgggacgggtaccggaccggtagggacggaacgtacgaaggtacgacgtacgtaacttaacgttagtttaccgtacgacccaaccgtagtaacgtaggttaacggtcgatacggtacgggtaggtaccggtcgggaacgggtacgaaacggtacggttacgtacccgttggttaccggaacgtaccgtaaccggtacgtacccgtccccggtacccgttccggtaccgttacccgtccgttccccggtaccccgttcccccg

SEQ ID NO: 202001 - DNA, 515 bp, Homo sapiens
  misc_feature: GYAE6OF02IV53Z.21.46.E02.1.454.CMB.1.raw
  modified_base (465)..(465): a, c, t, g, unknown or other
  misc_feature (465)..(465): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggccacggcccctgtgttagtgatatataaagacacgtgagacggccctacagagactccctagagcgtattctcgtggcctccagctcgagggacagcagtcacgttgactatcgagtgaagtccaggcagaggacgaggctagactattactagtacaaagagtagacagtagagttactgagttggtgttcggnggaggacgagctcgaccgtcgtaggcacgccgaaggcctacgcccctacg

SEQ ID NO: 202002 - DNA, 528 bp, Homo sapiens
  misc_feature: GYAE6OF02F92CJ.21.46.E02.1.454.CMB.1.raw
  modified_base (406)..(406): a, c, t, g, unknown or other
  misc_feature (406)..(406): n is a, c, g, or t
  modified_base (452)..(452): a, c, t, g, unknown or other
  misc_feature (452)..(452): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtcaggcagaggacgaggctgacttattacngtacaaacgagtagacgagtaggagtaactcagttgggtgttcggngggacggaccgtaaggctacggaccgtaccgttagggtactacggacccgaagggcccgtacgccccccgttacgg

SEQ ID NO: 202003 - DNA, 496 bp, Homo sapiens
  misc_feature: GYAE6OF02HKNG8.21.46.E02.1.454.CMB.1.raw
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagatccctgagcgattctctggctccagctcgagggacagcagtcacgttgactatcagtgaagtccaggcagaggacgaggctgactatactgtacaaanagtananagtagagtactnagttgggtgttcggcggaggaccgaagctggacgtccgtagcagccaggctcgcccctcgg

SEQ ID NO: 202004 - DNA, 520 bp, Homo sapiens
  misc_feature: GYAE6OF02G2RBW.21.46.E02.1.454.CMB.1.raw
  modified_base (316)..(316): a, c, t, g, unknown or other
  misc_feature (316)..(316): n is a, c, g, or t
  modified_base (460)..(460): a, c, t, g, unknown or other
  misc_feature (460)..(460): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggcccctgtgttagtgatatataaagacactgagacggccctanagagactccctgagcgattctctggcctccagctcgaggacagcagtcacgttgactatcagtgaagtcgagcaggaggacgaggctagactattactgtacaaacgagtagacgagtagagttactgtagttgggtgttcggnggaggaccgaagctaggacccgtcgtaggtcacggaccgaggccgtccgccccgttacgg

SEQ ID NO: 202005 - DNA, 524 bp, Homo sapiens
  misc_feature: GYAE6OF02HVWCP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggccccctgtgttagtgatatataaagacactgagacggccctcagagatccctgagcgattctctggcctccagctcgaggacagcagtcacgttgactatcagtgaagtcgaggcaggaggacgaggctagacttatactgtacaaacgagtagacagtagagtactcagttgggttgttcggacgggtagggacccgaaggtccgtgaccgtccgtaggtcgacggcccgaaggcctccggccccgttccgg

SEQ ID NO: 202006 - DNA, 556 bp, Homo sapiens
  misc_feature: GYAE6OF02F88JP.21.46.E02.1.454.CMB.1.raw
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtccaggcagaggacgaggctagacttattacgtgtacaaacgagtaagacgaagtaagaggttaactacgtagttggggttgttacgggacgggtacggaccgaaggccgtacggtaccgttaccgtaaggtaccgacggtaccccgaaggtccgtaccggcccccgttaccgg

SEQ ID NO: 202007 - DNA, 683 bp, Homo sapiens
  misc_feature: GYAE6OF02H8Q6S.21.46.E02.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtgggtccgaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaaagtaaatatgacttattggaaccaacagaagccaaggccaggcccctgtagttagtagatatataaaagcaactgaagacggccctnaagagactccctaggacgacgtattctcgtggcctacagctacggagggactagctacggtctaacgttcgtactaatacgtaagtacggtaaacgtcaaacggacgaacggaacgggaacgaacgggtacgtagtaaccttaaacgtttacgtaacgtaaccgtaaaacgtaacggttaagaaccgtaaaggtaacggtacggttaacgtaccgttaaggttggggtttacggttaccggggacggggtaacggggtaacccgtaaagggtaccgttacgggaacccggttaaccgttacgggttaacggaccgtaaccccggaaaccggtcgtaccccggtccccccgttaacccgggg

SEQ ID NO: 202008 - DNA, 525 bp, Homo sapiens
  misc_feature: GYAE6OF02FH9A2.21.46.E02.1.454.CMB.1.raw
  modified_base (258)..(258): a, c, t, g, unknown or other
  misc_feature (258)..(258): n is a, c, g, or t
  modified_base (314)..(314): a, c, t, g, unknown or other
  misc_feature (314)..(314): n is a, c, g, or t
  modified_base (328)..(328): a, c, t, g, unknown or other
  misc_feature (328)..(328): n is a, c, g, or t
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttatggtaccaanagaagccaggccaggccccctgtgttagtgatatataaagacactgagaggccctnagagatccctgagngattctctggcttccagctcgaggacagcagtcacgttgactatcagtgaagtccaggcagaggacgaggctgacttattactgtacaaacngtagacgagtagaggttactcagtttgggtgttcgggcggaagggaccgtaagcgtacggaccgttcgtaggtacacggacccgaaggcctcgcccccgttacgg

SEQ ID NO: 202009 - DNA, 541 bp, Homo sapiens
  misc_feature: GYAE6OF02GBGPH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcggggacagcagtcacgttgactatcagtgaagtccaggcaggaggacgaggctgactattactgtacaaacgagtaagacagtaagaggttactacgtagttgggttgttcgggacggagggaccaaggccttaggacccggttacgtaacggtccgacggaccccgaaaggcctccggtcccccgtcggtacccg

SEQ ID NO: 202010 - DNA, 559 bp, Homo sapiens
  misc_feature: GYAE6OF02JG7S1.21.46.E02.1.454.CMB.1.raw
  modified_base (259)..(259): a, c, t, g, unknown or other
  misc_feature (259)..(259): n is a, c, g, or t
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgtcttattggtaccaanagaagccaggccacggccctgtgttagtgatatataaagacactgagaggccctnagagactcccgtgagcgtattcncgtcggctccagctgaggacagcagtcacgttnactancagtagacgtccgagcaggacggtacgaggctgaacttagttctgtaacaatagtagacaggtaagacgttactcgtaaggttgggtcgttcgggaggtaacgggaccgaacggtcggtaggaaccccggttcggttaaggaccgaacggtacccaagggtccgtaccggcccccgttaccggg

SEQ ID NO: 202011 - DNA, 831 bp, Homo sapiens
  misc_feature: GYAE6OF02JZOIQ.21.46.E02.1.454.CMB.1.raw
  modified_base (227)..(227): a, c, t, g, unknown or other
  misc_feature (227)..(227): n is a, c, g, or t
tcagtcgtcgctcgcacgaccggtgctcgatttagactcatctacagggaaagggggtgggtccgaggaggcagaactctgggtgtctcaccatggcctggatccctctacttctccccctcctcactctctgcacaggctctgaggcctcctatgagctgacacacgccaccctcggtgtccagtcgtccccaggacagacggccaggatccacctgctctgcagntggactagaccaaaagaaatatgtacttattacggtaaccaacgaacgaagaccgacggccgaccggaccccgtggttacggttagagtactaataataaagaacacgtagagtacggaccctagacgagtactacccgtagacggtacgattttcctacttcggggcttccctaaggccgttacaacgggggtaccaaggtcccaagggttccaaccgggttttgaaccttaacgttaccgaaggtttacgaaagggtttccccaaaggggtcccgtaaagggaacggggtaaccggtaacggggaccgttagggtaaccctttaaacgttttaaccttacggttacccgtaaaaccgtaacggttaaacggaaaccgtaacgggttaaggtaaggggtttaaaccgttaccgtaaaggttttacgggggttagggtttttaccggggaccggggtaacggggggtaacccggtaaaacgggtacccggttacggggaacccccgggtttaccccgttaagggggttacccgtaaccgggttaaccccccggtaaagggggtaccccctttacggggacccccccccggtttaaccccggggg

SEQ ID NO: 202012 - DNA, 521 bp, Homo sapiens
  misc_feature: GYAE6OF02F5TMT.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctnagagatccctgagcgattctctggctccagctcgagggacagcagtccacgttgactatcagtgaagtccaggcaggaggacgaggctagacttattactgtacaaacagtacgagagtagaggtactgagttgggtgttcgggacggagggaccgaagcgtacggaccgtccgtaggtcacgcccgaaggcctacgccccgtacgg

SEQ ID NO: 202013 - DNA, 555 bp, Homo sapiens
  misc_feature: GYAE6OF02IBYM1.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctgcagatggactgaccaaaagaaatntgctttattggtaaccaaacagaagccaggccacggcccctgtgttagtgatataataaagacactgagaggccctcagagactcccgtgagcgtatttctctggcctccagctacgagggacagcagtctacgttgaactatcagtgaacgtcgaggcaaggagggacgaggctagacttattactagacaaacgagtaagacaggtaagagtactcgtagttgggtgttcggacgggacgggaccgaacgtcgacggtacccgtacgtaggtcaccggacccgaaggtcctacccggtccccgtaccgg

SEQ ID NO: 202014 - DNA, 544 bp, Homo sapiens
  misc_feature: GYAE6OF02H9V4P.21.46.E02.1.454.CMB.1.raw
  modified_base (289)..(289): a, c, t, g, unknown or other
  misc_feature (289)..(289): n is a, c, g, or t
  modified_base (370)..(370): a, c, t, g, unknown or other
  misc_feature (370)..(370): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgccaaaagaaatatgcttatggtaccaacagaagccaggccaggccctgtgtagtgatanataaaagacactgagaggccctcagagactcctgagcgaattctctggctccagctacaggacagcagtcacgttgactancagtgaagtcaggcaaggagacgaggctgaatattaactgtacaaacagtaagacagtaaggaagtactactagttcgggtgttcgggacggtaaggacccgaaagcgttaacgacccggttaccgaacggttcgacggacccgtaaagggcctccggtaccccccgttccggg

SEQ ID NO: 202015 - DNA, 518 bp, Homo sapiens
  misc_feature: GYAE6OF02GEN4S.21.46.E02.1.454.CMB.1.raw
  modified_base (258)..(258): a, c, t, g, unknown or other
  misc_feature (258)..(258): n is a, c, g, or t
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaanagaagccaggccaggcccctgtgttagtgatatataaagacactgagaggccctnagagatccctgagcgattctctggctccagctcgagggacagcagtcacgttgactatcagtgaacgtcaggcaggaggacgaggctagactattactgtacaaacagtagacgagtagagtactatagttgggtagttcggacggacgggacgtaaggcgtcggaccgtcgtaggtcacgcccgaaggccgtccgccccgtcgg

SEQ ID NO: 202016 - DNA, 246 bp, Homo sapiens
  misc_feature: GYAE6OF02IXG50.21.46.E02.1.454.CMB.1.raw
  modified_base (242)..(246): a, c, t, g, unknown or other
  misc_feature (242)..(246): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttccctcgtctctacgagcgggctggcaaggcgcatagnnnnn

SEQ ID NO: 202017 - DNA, 598 bp, Homo sapiens
  misc_feature: GYAE6OF02IYKZI.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggccaggcccctgtgttagtgatataataaagacactagagacggccctanagagtactcccgtagacgcgtattcctcgtcggtcctccgagtcgtacgaacgggacagacgtagtccgtaacggttcgaacgttatacgagttacggaacgtaccgaggacgaaggaacgggacggaggtacgtacgtacttaagttacgtagtaacctaaacgagtaagacgagtaaggtacgtactgtaaggttggtacgtcgggacggaggaccgaacggcgtacgaccgtacgtacggtacgaccgaccgacggtccgtccgtccccgtaccgg

SEQ ID NO: 202018 - DNA, 512 bp, Homo sapiens
  misc_feature: GYAE6OF02I45XA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtcaggcagaggacgaggctgactattactgtacaaacagtagacagtagaggtactcagttgggtgttcgggcggagggtaccgaaggctggaccgtccgtaggtcacggtcccgaaggctacgcccccgtaccgg

SEQ ID NO: 202019 - DNA, 552 bp, Homo sapiens
  misc_feature: GYAE6OF02HMA3Z.21.46.E02.1.454.CMB.1.raw
  modified_base (428)..(428): a, c, t, g, unknown or other
  misc_feature (428)..(428): n is a, c, g, or t
  modified_base (468)..(468): a, c, t, g, unknown or other
  misc_feature (468)..(468): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggccaggcccctgtgttagtgatataataaaagacaactgagaggccctcagagatccctgagcgattctactggctccagctcagggacacgcagtcacgtttgactatcagtagaacgtccaggcagagggacgaggctgaacttatactagtcaaanagtagacgagtagaggtacttcgagttgggtagttcgggnggaacgggtaccgaaggccgttaggaacccggttacgtaaggtccaacggaccccgaaggtccgtaccggacccccgttacggg

SEQ ID NO: 202020 - DNA, 571 bp, Homo sapiens
  misc_feature: GYAE6OF02JR8OR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagacggccctacagagactccctgagcgattctactggcctaccagctacgagggtacagcagtcacgttgactatcagtgaacgtcgaggcaggacggacgaggctgactattactgtacaaacgtgtaacgactaaggtagaacgttactagtagtttaggggttacgtcgggacgggacgggtaacccgaaggtaccgtacggtaacccggttcgtaagggtaccacgggtacccgaaggtcccgtaccgcccccgttaccggg

SEQ ID NO: 202021 - DNA, 525 bp, Homo sapiens
  misc_feature: GYAE6OF02IKZO2.21.46.E02.1.454.CMB.1.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (315)..(315): a, c, t, g, unknown or other
  misc_feature (315)..(315): n is a, c, g, or t
  modified_base (426)..(426): a, c, t, g, unknown or other
  misc_feature (426)..(426): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgcttattggtaccaanagaagccaggccaggcccctgtgttagtgatataataaagacactgagaggccctnagagactccctgacgcgtattctctggcctccagctcgagggacagcagtcacgttgactatcgagtgaacgtcgaggcaggaggacgaggctagactattactgaacaanagtagacagtaagacgttactcgtagttgggtgttcgggcggagggccaaggtcgtcggaccgtcgtaggtcacgacccgaaggcctccgccccttacg

SEQ ID NO: 202022 - DNA, 537 bp, Homo sapiens
  misc_feature: GYAE6OF02GZ0GM.21.46.E02.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgcttattggtaccaaacagaagccaggccaggcccctgtgttagtgatataataaagacactgagacggccctnagagactcccctgagcgtattctacgtggctccagctcgagggacagcagtcacgttgactatcagtgaagtccaggcaggaggacgaggctagacttagttactgtaaccaaacgtagtaacgacgagtagtacgtactgtagttgggtcgttcggacgggacggacgaggactacggaccgtcgtaggcacggaccgacggcctccgccccgtacgg

SEQ ID NO: 202023 - DNA, 537 bp, Homo sapiens
  misc_feature: GYAE6OF02HB4B0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagacggccctcagagactcctagagcgtattctctggctccagctcgacgggacagcagtcacgttgactatcagtgaagtccaggcaagaggacgaggctagacttattactgtacaaagagtaggacagtagtagtactacgtagttgggtgttacgggcggacgggaccgaaggctacggaccgttaccgtaggtccgacgacccgaacggtcgtaccggccccgtaccgg

SEQ ID NO: 202024 - DNA, 573 bp, Homo sapiens
  misc_feature: GYAE6OF02HFFWS.21.46.E02.1.454.CMB.1.raw
  modified_base (368)..(368): a, c, t, g, unknown or other
  misc_feature (368)..(368): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggcccctgtactggtcatccatgagccagtcgacgcactccgggatccctgagagattctctcgcctccagctcagggacaggtcgccacttgactancgaggtcgggccgaggtggacgagtgaagctagactatattagttacgacacgagactagtagtgtctagtacgtagggggtatcgggcgggaacgggtacgtaaggttcgtaccggtcgttcggtacgtaacggtcccgaaggtccgtaccggtcccccgttcggtacccgtccgtcgttccgttacccccgtacccttccccg

SEQ ID NO: 202025 - DNA, 532 bp, Homo sapiens
  misc_feature: GYAE6OF02JCG67.21.46.E02.1.454.CMB.1.raw
  modified_base (418)..(418): a, c, t, g, unknown or other
  misc_feature (418)..(418): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatatgcttattggtaccaacagaagccaggccaggcccctgtgttagtgatatataaagacactgagaggccctcagagatccctgagcgattctctggcctccagcctcgagggacagcagtcagttgactatcagtgaagtccaggcaggaggacgaggctgactattactgtacaanagtagacagtagagttactgagttgggtgttcggacggtagggaccgaaggctacggtaccgttaccgtagggtaccacggaccccgaaggcccttacggccccccgttaccgg

SEQ ID NO: 202026 - DNA, 536 bp, Homo sapiens
  misc_feature: GYAE6OF02FUE2M.21.46.E02.1.454.CMB.1.raw
  modified_base (314)..(314): a, c, t, g, unknown or other
  misc_feature (314)..(314): n is a, c, g, or t
  modified_base (441)..(441): a, c, t, g, unknown or other
  misc_feature (441)..(441): n is a, c, g, or t
  modified_base (457)..(457): a, c, t, g, unknown or other
  misc_feature (457)..(457): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctgagcgattctctggctccagctcagggacagcagtcacgttgactatcgagtgaagtccaggcagaggacgaggctagactagttactgtacaaactagtagacagtagagttactntagttgggtgttcggngggaacgggaccgaaggtccgtaggacccggttacgtagggtccacggaccccgtaagggcctaccggcccccgtccgg

SEQ ID NO: 202027 - DNA, 538 bp, Homo sapiens
  misc_feature: GYAE6OF02HYRUG.21.46.E02.1.454.CMB.1.raw
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggccctcagagatccctgagcgattctctggctcagctcgagggacagcagtcacgttgactatcagtgaagtccgagcagaggacgagctgactattacngtacaaangtaagacaagtagagtactcgtagttgggtagttcgggacggagggaccgtaaggtcctacggtacccgttaccgtaggtcctaacggcccgtaaagggcccttaccggcccccgttaccggg

SEQ ID NO: 202028 - DNA, 562 bp, Homo sapiens
  misc_feature: GYAE6OF02JE1XI.21.46.E02.1.454.CMB.1.raw
  modified_base (386)..(386): a, c, t, g, unknown or other
  misc_feature (386)..(386): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggccccctgtgttagtgatatataaagacactgagaggcctcagagatccctgagcgattctctggctcagctcaggggacagcagtcacgttgactatcagtagatccaggganaggaggacgaggctgaactagttactgtacaaacagtagacaagtagaacggtactacgtattgggtaggttccggcgggtaagggacccgaaaggtccgtacggaacccggttaccgttaagggttccgaaacggccccgaaacgggtcctaccgggtacccccccgttaccggg

SEQ ID NO: 202029 - DNA, 501 bp, Homo sapiens
  misc_feature: GYAE6OF02F34J4.21.46.E02.1.454.CMB.1.raw
  modified_base (258)..(258): a, c, t, g, unknown or other
  misc_feature (258)..(258): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaanagaagccaggccaggcccctgtgttagtgatatataaagacactgagaggcctnagagatccctgancgattctctggctccagctcgagggacagcagtcacgtgactatcagtgaagtccaggcagaggacgaggctagactattactgtacaaagagtagatagtagagtactgtagttgggtgttggcggaggacgaaggtcgtggaccgtcgaggtcaggacccagctcgcccctcgg

SEQ ID NO: 202030 - DNA, 520 bp, Homo sapiens
  misc_feature: GYAE6OF02HFJWH.21.46.E02.1.454.CMB.1.raw
  modified_base (315)..(315): a, c, t, g, unknown or other
  misc_feature (315)..(315): n is a, c, g, or t
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtcgttagtgatatataaagacactgagaggccctnagagatccctgagcgattctctggctccagctcagggacagcagtcacgttgactatcagtgaagtccaggcaggaggacgaggctgacttattactgtacaaanagtaagacagtagaggtactgtagttgggtgttcgggcggagggaccgaaggccgtaggaccgtaccgtaggtcacggcccgaaggcgtcgccccctcgg

SEQ ID NO: 202031 - DNA, 529 bp, Homo sapiens
  misc_feature: GYAE6OF02JBEO9.21.46.E02.1.454.CMB.1.raw
  modified_base (256)..(256): a, c, t, g, unknown or other
  misc_feature (256)..(256): n is a, c, g, or t
  modified_base (311)..(311): a, c, t, g, unknown or other
  misc_feature (311)..(311): n is a, c, g, or t
  modified_base (419)..(419): a, c, t, g, unknown or other
  misc_feature (419)..(419): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaanagaagccaggccaggcccctgtgttagtgatatataaagacactgagaggccctnagagatccctgacgcgattctctggctccagctcgagggacagcagtcacgttgactatcagtgaagtccaggcaggaggacgaggctagactattactgtacaaacngtagacgagtagaggtactacagttgggtgttcgggacggacggaccgaagtccgtaggtacccgtaccgttaggtccgacggacccgaaggcctccggcccccgtcggg

SEQ ID NO: 202032 - DNA, 511 bp, Homo sapiens
  misc_feature: GYAE6OF02I0S6I.21.46.E02.1.454.CMB.1.raw
  modified_base (242)..(242): a, c, t, g, unknown or other
  misc_feature (242)..(242): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctgcagatggactgccaaaagaaatntgcttattggtaccaacagaagccaggccaggcccctgtgttagtgatatataaagacactgagaggccctnagagatccctgagcgattctctggctccagctcgagggacagcagtcacgttgactatcagtgaagtcaggcagaggacgaggctgacttattactgtacaaacagtaagacagtagagtactcagttgggtgttcggcggaagggaccgaagctacgaccgtcgtaggtcacggcccgaaggcctcgccccctcgg

SEQ ID NO: 202033 - DNA, 543 bp, Homo sapiens
  misc_feature: GYAE6OF02IYT97.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagactccctgacgcgtattctcgtggctccagctcgagggacagcagtcacgttgactatcagtagaacgtccgaggcaggacggacgaggctagtactattacgtgtacaaacagtagacgagtaagagtactcgtagttgggtgttacgggcggacggaccgaaggtcgtacggacccgttccgtaggtaccgacggacccgaggtccgtccggcccccgtacgg

SEQ ID NO: 202034 - DNA, 501 bp, Homo sapiens
  misc_feature: GYAE6OF02FOF4W.21.46.E02.1.454.CMB.1.raw
  modified_base (314)..(314): a, c, t, g, unknown or other
  misc_feature (314)..(314): n is a, c, g, or t
  modified_base (417)..(417): a, c, t, g, unknown or other
  misc_feature (417)..(417): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctnagagatccctgagcgattctctggctccagctcagggacagcagtcacgttgactatcagtgaagtccaggcagaggacgaggctgacttatactgtacaaanagtanacgagtagagtactcagttgggtgtcggcggaggacgaagctaggaccgttcgtaggcacgccaaggctcgcccctcgg

SEQ ID NO: 202035 - DNA, 503 bp, Homo sapiens
  misc_feature: GYAE6OF02JNBHV.21.46.E02.1.454.CMB.1.raw
  modified_base (254)..(254): a, c, t, g, unknown or other
  misc_feature (254)..(254): n is a, c, g, or t
  modified_base (370)..(370): a, c, t, g, unknown or other
  misc_feature (370)..(370): n is a, c, g, or t
  modified_base (449)..(449): a, c, t, g, unknown or other
  misc_feature (449)..(449): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatccacctgctctgcgatggactgccaaagaaatatgctatggtacacanaagccaggccaggccccctgtcgttagtgatatataaaagacaactgagaggccctacagagatcccctgagcgattctactggctcagctcaaggacagcagtcacgttgactancaagtgaatccaggcagagacgagctgactatatgtacaaacgagagacagtagaagttactcagttgggtagttcggngagggaccaaggctagacgtcctaggtacagacccaaggcctacgcccctacgg

SEQ ID NO: 202036 - DNA, 572 bp, Homo sapiens
  misc_feature: GYAE6OF02HDZK1.21.46.E02.1.454.CMB.1.raw
  modified_base (242)..(242): a, c, t, g, unknown or other
  misc_feature (242)..(242): n is a, c, g, or t
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctgcagatggactgaccaaaagaaatntgacttattggtaccaacagaacgccaggccacggcccctgtgttagtgatataataaagacactgagaggccctanagagactcccgtgagcgtattctcgtggctccgagctcgaggacagcagtcagttacgactatcgagtagaacgtccgaggcaggaggacgaggctgacttattactgtacaaacgaggtaagacgtaagtacggagttactacgtaggtttgggtgttccggggacgggtaagggaccgaaggtccgtacggacccgttaccgttaaggtccgaccggtacccgtaagggtccgtcccggtccccgtaccgg

SEQ ID NO: 202037 - DNA, 571 bp, Homo sapiens
  misc_feature: GYAE6OF02I4MI5.21.46.E02.1.454.CMB.1.raw
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggccaggcccctgtgttagtgatatataaagacactgagaggccctacagagatccccgtgagcgattctctggcctccgagctcgagggacagcagtcacgttgactatcgagtgaacgtccgaggcaaggaaggacgaggcgtagactattacngtaccaaagtagtaagacagtaagagttaactcgtagttgggtagttacgggacgggtaagggaaccgtaaggtacgtacggtaacccggttaccgtaaggtaccgtaccggacccgtaagggccgttacccggcccccgttaccgg

SEQ ID NO: 202038 - DNA, 543 bp, Homo sapiens
  misc_feature: GYAE6OF02JHRY7.21.46.E02.1.454.CMB.1.raw
  modified_base (241)..(241): a, c, t, g, unknown or other
  misc_feature (241)..(241): n is a, c, g, or t
  modified_base (316)..(316): a, c, t, g, unknown or other
  misc_feature (316)..(316): n is a, c, g, or t
  modified_base (453)..(453): a, c, t, g, unknown or other
  misc_feature (453)..(453): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaaccaacagaagccaggccaggccccctgtcgttagtgatatataaagacactgagaggccctnagagactccctagagcgattactcgtggtcctccgagcctcgacgggacagcacgtacacgttgactatcagtgagtccaggcaggagacgaggctagacttattactgtacaaacgtgtacgacagtagagttacncgtagttgggtgttacgggacggaggaccgaaggctacggaccgttaccgaggttacacggacccgaaggccttaccggaccccgtacgg

SEQ ID NO: 202039 - DNA, 525 bp, Homo sapiens
  misc_feature: GYAE6OF02FXOFF.21.46.E02.1.454.CMB.1.raw
  modified_base (354)..(354): a, c, t, g, unknown or other
  misc_feature (354)..(354): n is a, c, g, or t
  modified_base (371)..(371): a, c, t, g, unknown or other
  misc_feature (371)..(371): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatcccctgagcgattctctggctccagctcgagggacngcagtcacgttgactancagtgaagtccagcagaggacgaggctagactattactgtacaaacagtagacagtagagtacngagttgggtgttcgggcggaggaccgtaaggcttacggaacccgttccgtaggtccacggacccgaaggtcctaccgcccccgttaccgg

SEQ ID NO: 202040 - DNA, 491 bp, Homo sapiens
  misc_feature: GYAE6OF02G03ZY.21.46.E02.1.454.CMB.1.raw
  modified_base (346)..(346): a, c, t, g, unknown or other
  misc_feature (346)..(346): n is a, c, g, or t
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctnagggacagcagtcacgttgactatcagtgaagtccaggcagaggacgaggctgacttattactgtacaaacagtagacagtagagttacntgtggtgtcggngaggacaagctgaccgtctaggcacgccgaagctcgcccctcg

SEQ ID NO: 202041 - DNA, 521 bp, Homo sapiens
  misc_feature: GYAE6OF02FIMY4.21.46.E02.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtcgttagtgatatataaagacactgagaggccctcagagatccctgagcgattctctggctccagctcgagggacagcagtcacgttgactancagtgaagtccaggcagaggacgaggctagacttatactgtacaaacagtagacaaggtaagaggttactcagttgggtgttcgggcgggaggaccgaaggcacggtaccgtctaggcacggcccgaaggtcctcgcccccgtacggg

SEQ ID NO: 202042 - DNA, 696 bp, Homo sapiens
  misc_feature: GYAE6OF02ISZ8V.21.46.E02.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccactgctcgtgganattcattgaccaaaaagatactacttgttcggttccagcagaagtcgaggccacggcccctgtactggtcatccagtggacgccagtcgaacgaccacgtccggactcccgtagagtacgttactctcgtccgcctacgcgtcgtacggacggacgtcggtccgaccttacgtacgtacgtacgtacggtacggggtcccggtaacggtcgggaacgacgtacgaggtacgtacgtaaccgtacttacgtttaacggttacggaccgtaaccgacgtaacgaacggttaggtacggttacgtacggtacgttacgggggttagggttaccgggtacggggtaaacgggtaaccggtaacgttacgggttacccggttaccgtttcgggtacgtaaccggtaaccggacccgtacggttcccgaccccggttccgtaccgtacccgttacccgttcccggtccccgttcccccg

SEQ ID NO: 202043 - DNA, 580 bp, Homo sapiens
  misc_feature: GYAE6OF02F23OH.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntcgcttattggtaccaacagaagccaggccaaggcccctgtcgttagtgatatataaagacactgagaggccctcagagatcccgtgagcgattactcgtggctccagctcgagggcagcagtcacgttgactatcagtcgaagtccgaggtcaggaggacgaggctgactattacgtgtaccgaaacaggtagacgtaggtaagaggtactaccgtagtttggggtcgttcgggacgggacgggtaaccgaaggtaccggtacggtacccggttaccgttaaggttacccgacggaccccggtaaaggcccgttacccggaccccccggttacccgg

SEQ ID NO: 202044 - DNA, 529 bp, Homo sapiens
  misc_feature: GYAE6OF02GG70U.21.46.E02.1.454.CMB.1.raw
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (409)..(409): a, c, t, g, unknown or other
  misc_feature (409)..(409): n is a, c, g, or t
  modified_base (437)..(437): a, c, t, g, unknown or other
  misc_feature (437)..(437): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgcttattggtaccaanagaagccaggccaggcccctgtgttagtgatatataaagacactgagacggccctcagagatccctgacgcgattctctggctccagctcgagggacagcagtcagttgactatcagtgaagtcagcagaggacgagctagactattacngtacaacagtagacgagtagaggtactnagttgggtacgttcgggacggacgggacgtaaggtcgtacgacccgttcgtagggtcaccggcccgaagggtcctaccggcccccgttacgg

SEQ ID NO: 202045 - DNA, 952 bp, Homo sapiens
  misc_feature: GYAE6OF02I72SW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccatcctcggtgtcagtcgtccccaggacagacggccaggatcacctgctctgcagatggactgaccaaaagaatatgtctttaattggtaaccaaacaaggaacgccgaacggcccaacggcccccttggttacgtttaggtacgtaattaagtaagtaaaacgaccacgtaggaacggacggcccctagaacgacgtactcccgtagacggacgtactttccgtcgtcggtccttacccgaggtaccgttacgaacggggtaaccaacggaccgtaacggtttacccgtaaccgggttttacgaaacctttaacgttaccgtaaaggttacggaaaacggtttacccgaaggggttaccgaaacggggtaaacggggaaccgggtaacgggtaccgttaacgggtaaaccctttaaacgttttaacccgttaacggtttaaacccgaaaaaccggttaacgggttaaaccgggtaaaaccggttaaacggggtttaaacgggtaaaccggggttttaaacccgtttaaaccgggtttaaagggggttttttaacggggggtttttaccgggggttttaacccggggggtaaccgggggggtaaaaccggggggttaaacccccggtaaacggggttaaccccgggttttaacccgggggtaacccccccgggttttaaccgggtttaaacccgggggtttaaccccgtaaacccggggtaacccccccgggtaaaccgggggtttaccccgttaccccccccggggtttaacccccccccgggg

SEQ ID NO: 202046 - DNA, 617 bp, Homo sapiens
  misc_feature: GYAE6OF02GGHJF.21.46.E02.1.454.CMB.1.raw
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
tcagtcgtcgctcgcacgaccggtgctcgatttagactcatctacagggaaaggggtagggtccgaggagggcagaactctgggtgtctcaccatggcctggatcctctacttctcccctcctcactctctgcacagctctgaggcctcctatgagctgacacagccaccctcggtgtcagtcgtccccaggacagacggccaggtatcacctgctctgcagatggactgaccaaagaatatgtcttatgtacaacagaagaccagccagccctgtactagtgatactaataaagacacgtagagacggaccctacaganattcccngacgcgattctctggccttaccgagcctgacggtacgagctacgtctacgttcgactataccgagttacgaacgtaccgaagccgaaggaacgggaccgtaagggctacggtaactaacgtttaactgtaaaccgaaacgtaaagtacgtaaaccaaggttaacggaaccgtttaagtacctaaaggtttcggttaagggtccggttacggggaaccggtacggtaaacggcgttaggacccgttacggtaggtacgtacgaccgacgggtatcccggacccctaccggg

SEQ ID NO: 202047 - DNA, 522 bp, Homo sapiens
  misc_feature: GYAE6OF02IG7OG.21.46.E02.1.454.CMB.1.raw
  modified_base (298)..(298): a, c, t, g, unknown or other
  misc_feature (298)..(298): n is a, c, g, or t
  modified_base (305)..(305): a, c, t, g, unknown or other
  misc_feature (305)..(305): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaatatgcttatggtacaacagagcagccagcccctgtgttagtgatatataaagacactgagnggccctnagagatcccgtgagcgattcctctggctccagctacagggacagcagtcacgttgactatacagtagaagtcgaggcaggaggacgaggctagactattactgtacaaacgagtagacgagtaagagtactcgtagttgggtgttcggacgggacggaccgaagactggaacccgtcgtaggtcgacgacccgaaggtcctccgtcccccgtaccgg

SEQ ID NO: 202048 - DNA, 564 bp, Homo sapiens
  misc_feature: GYAE6OF02GLARA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctacagagactccccgtgagcgtattctctggctccagctcaggggacagcagtcacgttgactatcagtgaacgtccgaggtcaggacggacgaggctgactattactagtacaaacagtagaacgagtaggaaggttactacgagttggggttcgtacggggacgggtagggaccgaaggtcctaggaacccggttccgtagggtaccacgggtaccccaagggtcccgttccggaccccccgtttaccggg

SEQ ID NO: 202049 - DNA, 515 bp, Homo sapiens
  misc_feature: GYAE6OF02JG1RE.21.46.E02.1.454.CMB.1.raw
  modified_base (458)..(458): a, c, t, g, unknown or other
  misc_feature (458)..(458): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgcttattggtaccaacagaagccaggccaggcccctgtgttagtgatatataaagacactgagacggccctcagagactccctgacgcgacttctcgtggctccagctcgagggacagcagtcacgtgactatcagtgagtcaggcaggaggacgaggctgactatactgtacaaatagtagacagtagacgtactcgtagttgggtgttcgggnggaggaccgaaggctaggccgtacgtaggcgacgacccgaggccgtcgccccgtcgg

SEQ ID NO: 202050 - DNA, 548 bp, Homo sapiens
  misc_feature: GYAE6OF02HFTGW.21.46.E02.1.454.CMB.1.raw
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggccctcagagatcccctgagcgattctctggctccagctcgagggacagcagtcacgttgactatcgagtgaagtcaggacagaggacgaggctagactattactgtacaaacaggtanataagtagaggtatcgtagttgggtnttcgggaggacgggaaccgtaaggccgtacgggaccgttacccgtaaggtaccgacggaccccgaaagggtcccgtacggacccccgttacccggg

SEQ ID NO: 202051 - DNA, 525 bp, Homo sapiens
  misc_feature: GYAE6OF02FX6RZ.21.46.E02.1.454.CMB.1.raw
  modified_base (315)..(315): a, c, t, g, unknown or other
  misc_feature (315)..(315): n is a, c, g, or t
  modified_base (372)..(372): a, c, t, g, unknown or other
  misc_feature (372)..(372): n is a, c, g, or t
  modified_base (444)..(444): a, c, t, g, unknown or other
  misc_feature (444)..(444): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaggccccctgtgttagtgatatataaagacactgagaggccctnagagatccctgagcgattctctggctccagctcgaggacagcagtcacgttgactancagtagaacgtccaggcaggaggacgaggctgacttattacgtgtacaaacagtagacgagtagacgttatnagttgggtgttcggacgggaggaaccgaagcgtaggacccgtcttaggtccacggtcccgaaggcctccgcccccgttcgg

SEQ ID NO: 202052 - DNA, 567 bp, Homo sapiens
  misc_feature: GYAE6OF02IUT5U.21.46.E02.1.454.CMB.1.raw
  modified_base (489)..(489): a, c, t, g, unknown or other
  misc_feature (489)..(489): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagacggccctcgaagagactcccgtgagcgtattctccgtggcctccgagctcgagggacagcagtctacgttgaactagtcagtgaacgtcgagcgaagacggacggaggcgtagaaccttagttaacctgtacaaacgtagtaagacgaagtaaggtagtactgtagttgggtcggttacgggngggtaacggaccgaagtcgtcggtaacccggtacgtacggtacgacggacccgaaggccgttacccgccccgttacgg

SEQ ID NO: 202053 - DNA, 502 bp, Homo sapiens
  misc_feature: GYAE6OF02GNC30.21.46.E02.1.454.CMB.1.raw
  modified_base (333)..(333): a, c, t, g, unknown or other
  misc_feature (333)..(333): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatcccctgagcgattcnctggctccagctcagggacagcagtcacgttgactatcgagtgaagtccagggcaggaggacgaggctgaactattacngtacaaacagtaganagtagagtactnagttgggtgttcggcgagggaccaaggctggaccgtctaggtcaggcccaggctgcccctcgg

SEQ ID NO: 202054 - DNA, 758 bp, Homo sapiens
  misc_feature: GYAE6OF02JZBV1.21.46.E02.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagtcgtcgctcgcacgaccggtgctcgatttagactcatctacaggaaaggggtaggggtccgaggaggcgagaactctgggtggtctcaccatggcctggatccctctacttctccccctccctcacctctctgcacaggctctgaggcctcctactgagctgacacagcccaccctcggtgtcagtcgtccccagganacgaccggccaggtatccgacctgctcctgccagatcggactcgaccaaaagaaattngtccttattagtaccgaacgtaagaagaccgaacggaccgacggacccccgtaggttcgttaggaaccgttagtagtaagttaaagactaaacgtgaaggtacgcccgtagtaaccgagtaactccgtacgacggtcgaaacgttcgtacgtcgtcttccgacgtcctacggaggtaccaggccaggtacctaggttaccaaccgtttagacctagtacggaaacgttcgaaacggtcgaaacgggacgaacgggacgggtaccgtagttacgtaaacttacgtacttaaccggtaaaacgtacggtaaacggaccgtaaacgggttaacgacgggtttaaacgtaacggttaaacggttcgggtttacgttcggggtacggtttaccgggggaacggtaaacccggtacggttaaccggtaacccggttacccggttaacggccggtaacccggtacccggtaagggtacccccgtcggaccccccgtttacccggg

SEQ ID NO: 202055 - DNA, 507 bp, Homo sapiens
  misc_feature: GYAE6OF02FM8CS.21.46.E02.1.454.CMB.1.raw
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgctttattggtaaccaacagaagccaggccaggcccctgtgttagtgatatataaagacactgagacggccctacagagactccctagagcgattctctggcctccacgctcgaagggacagcagtcacgttgactatcagtgaacgtccgaggcaaggaggacgaggctgactattactgtacaanagtagacagtagagtacntagtggtgtggcggaggacgagctcgaccgtcgtagcacgaccgagctaccgcccgtcgg

SEQ ID NO: 202056 - DNA, 547 bp, Homo sapiens
  misc_feature: GYAE6OF02H84BI.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattaggtaccaacagaagcaggccaggcccctgtgttagtgatatataaagacactgagaggccctnagagactccctagagcgattctctggctccagtctacgagggacagcagtcacgttgactatcgagtgaacgtcaaggcaaggaggacgaggctagactattacagtacaaatagtaagacaagtagacggttacacgtagttgggtagtcgggacgggacgggaccaaggtccgtaggacccgttacgtagggtacaccggacccgtaaggcccgtccgacccccgttaccgg

SEQ ID NO: 202057 - DNA, 542 bp, Homo sapiens
  misc_feature: GYAE6OF02G7N92.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgacttattggtaccaacagaagccaggccaggcccctgtgttagtgatatataaagacactgagaggccctcagagactccctgagcgaattctctggctccagctcgacgggacagcagtcacgttgactatcagtgaagtccaaggcaggacggacgagctagacttattactgtacaaactgtaagacagtagaggtactcgtaagttgggtgttcgggagggacgggaccaaggctacggaccgttaccgtacgggtcaccggtaccgaacgggccttaccggcccccttaccggg

SEQ ID NO: 202058 - DNA, 518 bp, Homo sapiens
  misc_feature: GYAE6OF02JEAPU.21.46.E02.1.454.CMB.1.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
  modified_base (380)..(380): a, c, t, g, unknown or other
  misc_feature (380)..(380): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggaccaacagaagccaggccaggcccctgtgttagtgataatataaagacacgtgagaacggccctanagagactcccctgacgcgtattctcgtggctccagctgagggacagcagtcacgttagactancagtgaagtccaggacaggaggacgaggctagacttatactgacaaacagtagactagagagtactgtagttggggtgtcggacggagggacaaggctggaccgtccgtagcacgacccgaggcctccgcccctacgg

SEQ ID NO: 202059 - DNA, 604 bp, Homo sapiens
  misc_feature: GYAE6OF02I286W.21.46.E02.1.454.CMB.1.raw
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
  modified_base (395)..(395): a, c, t, g, unknown or other
  misc_feature (395)..(395): n is a, c, g, or t
  modified_base (587)..(587): a, c, t, g, unknown or other
  misc_feature (587)..(587): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgtactttatcggtaaccaaacagaagccaggccaggccctgtgtagtgataatataaagacactagagacggccctanaagagactccctagaacgcgtatttcncgttggcctccagctacgaagggacacggactagtactacggttanaactatcaagtcgtaagtcccgaaggcgaggacggacggacggctagaacttaagttacgtagtaacaaaacgtaagtaacgacgtaaggttaaggacgttactagtaggtttcgggtaggttcgggacggtaggaacccgtaagtccgaacggtaccgtaccgttaggtaccacggtacccgaaggtcccncccggtaccccgtcggg

SEQ ID NO: 202060 - DNA, 595 bp, Homo sapiens
  misc_feature: GYAE6OF02IW17R.21.46.E02.1.454.CMB.1.raw
  modified_base (304)..(304): a, c, t, g, unknown or other
  misc_feature (304)..(304): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgcttatggtaccaacagaagccaggccacggcccctgtgttagtgatatataaagacacngaggagccctgacgagactcccgtggacgcgacttctcgtggcctccagtctacgacgggacagcagtcaggttcactagtcagtgaacgtccgaggcaggaggacggaggtctagactattctacgtacaaacgagtaacgacgagtaacggtacgttactacgtaggttcggggttaggttacgggacgggtaacgggtaccgaaacggtcgtaccgggtaacccgtaccggttaggttacccgacggtaaccccgtagggacccgtaccccgtcccccggttaacggg

SEQ ID NO: 202061 - DNA, 555 bp, Homo sapiens
  misc_feature: GYAE6OF02GPB3S.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggccctgtgttatgatatataaagacactgagaggccctnagagatccctagagccgattctactggcctcagctcgagggacagcagtcacgttgactatcagtgaagtcagcagacggagagctagactattactagtacaaacgagtaacgactaagtaagaacggttactacgtagttggggttagttcgggacgggaagggtaccgaaggtccgtaggtaaccccgtccgttaaggtcgaccggtacccgaagggtccctaccggtcccccttaccgg

SEQ ID NO: 202062 - DNA, 523 bp, Homo sapiens
  misc_feature: GYAE6OF02GTSFN.21.46.E02.1.454.CMB.1.raw
  modified_base (312)..(312): a, c, t, g, unknown or other
  misc_feature (312)..(312): n is a, c, g, or t
  modified_base (377)..(377): a, c, t, g, unknown or other
  misc_feature (377)..(377): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagactcccgtgagcgattctctggctccagctcgagggacagcagtcacgttgactatcagtnaagtccaggcaggaggacgaggctgacttatactgtacaacagtagacagtagagtactgtagttgggtgttcggacgggaggaccgaaggtctacggtaccgtcgttaggcgtacggacccaagggcctaccggcccccttacgg

SEQ ID NO: 202063 - DNA, 538 bp, Homo sapiens
  misc_feature: GYAE6OF02JGVN8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctgcagatggactgaccaaagaaatatgcttattggtaccaacagaagccaggccaggcccctgtgttagtgatatataaagacactgagacggccctcagagatccctgagcgattctctggctccagctcgagggacagcagtcacgttgactatcagtagagtccaggcagacggacgaggctgactattactgacaaacagtagactagtagtagtactacgtagttgggtgttcggagggacggaccgtaaggccgtacggacccgttacgtacggtcacggtacccgaaggtcccgtaccggcccccgttaccgg

SEQ ID NO: 202064 - DNA, 592 bp, Homo sapiens
  misc_feature: GYAE6OF02I86SY.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggattgccaaaagaatagtgtacttattaggtaccaaacagaagcacggccgacggtccccctggtacgttagtagtatataataaagacaactgacgacgacctacgagtagactacccgtagagcgtattcgtaccgtggctcagcgtacgacgggacacgcagtcacgttgactatcagtgaacgtcagtcgagacggacgaggctacgactacttactacgtacaaacgagtaagacgaagtagtacggttactacgtagttcgggtgttacggacgggtacggaaccgtacggtacgtacggtacccgtaccggttacgaccgttacgaccgtaacggtaccgtacccggtccccgttacccggg

SEQ ID NO: 202065 - DNA, 546 bp, Homo sapiens
  misc_feature: GYAE6OF02GC32G.21.46.E02.1.454.CMB.1.raw
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagacggccctnagagactcccgtgacgcgtattctcgtggcctccgagctcgagggacagcacgtctacgttcgactancagtgaacgtcaggcaggaggacggaggctagacttattacgngtacaaacgagtaagacgtagtaagacggtactctagttgggtcgttcgggaggacgggaccgaaggcgtacgtaccgtccgtaggtcgacggcccgaaggcctccggtccccgtaccgg

SEQ ID NO: 202066 - DNA, 508 bp, Homo sapiens
  misc_feature: GYAE6OF02JIMVA.21.46.E02.1.454.CMB.1.raw
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagactccctgagcgattctctggctccagctcgagggacagcagtcacgttgactatcagtgaagtccaggcagaggacgaggctgactattactgtacaaanagtanacgagtagagtactcgagttgggtgtcggacggaggaccaagtctagacccgtcgtaggcacgacccgaaggctcgccccgtcgg

SEQ ID NO: 202067 - DNA, 513 bp, Homo sapiens
  misc_feature: GYAE6OF02GCVUG.21.46.E02.1.454.CMB.1.raw
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttatggtaccaacagaagccaggccaggccccctgtgttagtgatatataaagacactgagaggccctcagagatccctgagcgattctctggctcagctcaggacagcagtcacgttgactancagtgaagtcaggcagaggacgaggctgactatactgtacaaacagtanacagtanaggttactcagttgggtagttcggcggaagggaccaaggctaggaccgtccgtaggtccaggaccccaaggtccgtcgcccccgttcgg

SEQ ID NO: 202068 - DNA, 562 bp, Homo sapiens
  misc_feature: GYAE6OF02FXDAV.21.46.E02.1.454.CMB.1.raw
  modified_base (243)..(243): a, c, t, g, unknown or other
  misc_feature (243)..(243): n is a, c, g, or t
  modified_base (259)..(259): a, c, t, g, unknown or other
  misc_feature (259)..(259): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatntgcttatggtaccaanagaagccaggccaggcccctgtgttagtgatatataaagacactgagaggccctnagagatccctgagcgattctctggctccagctcgaggacagcagtcacgttgactatcagtagagtccaggtcaagaggacgaggctagacttagttactagtacaaacgtagtagactaagtaggacggttactacgtagtttcgggtagttcgggacggtacgggaccgtaaaggccgttacggtacccgtacgttacgggtccgtacggaccccgaagggtcctcccgggacccccgttaccggg

SEQ ID NO: 202069 - DNA, 530 bp, Homo sapiens
  misc_feature: GYAE6OF02FKJD2.21.46.E02.1.454.CMB.1.raw
  modified_base (314)..(314): a, c, t, g, unknown or other
  misc_feature (314)..(314): n is a, c, g, or t
  modified_base (482)..(482): a, c, t, g, unknown or other
  misc_feature (482)..(482): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagaggccctnagagatcccctgacgcgattctctggctccagctcagggacagcagtcagtgactatcagtgaagtccaggcaaggagggagacggctagacttagttactaggtacaaacgtagtaagactaagtaagaggttactagtagttgggtgtcgggacggaggacgaagngtacgaccgttaccgtaggcacgcccgaaggcctccgccccgtaccgg

SEQ ID NO: 202070 - DNA, 541 bp, Homo sapiens
  misc_feature: GYAE6OF02GF6X9.21.46.E02.1.454.CMB.1.raw
  modified_base (318)..(318): a, c, t, g, unknown or other
  misc_feature (318)..(318): n is a, c, g, or t
  modified_base (428)..(428): a, c, t, g, unknown or other
  misc_feature (428)..(428): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgcttattggtaccaacagaagccaggccacggcccctgtgttagtgatataataaagacactgagacggccctnaagagatcccgtgacgcgtattcctctggctccagctcgagggacagcagtcacgttgactatcagtcgaagtccagcagacggacgaggctgactattactgtacaaanagtagacagtagagtactgtagttggggtagttcgggacgggtaacgggacctaaggctacggacccgttcgtaggtacacggacccaacgggctacccggccccgttaccgg

SEQ ID NO: 202071 - DNA, 600 bp, Homo sapiens
  misc_feature: GYAE6OF02H7S6X.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgactttattacggtaaccaacagaagccaggccacggcccctgtgttagtagataatataaagacactgagacggccctgagagtactccctgacgcgtaattccgttcgtaggtccttaccgagtcctacggagggaccaggctacgtcgtaacgttgaacttagtcaagtgaacgtccgagcaggagacgaggctagacttattacgtgtaacaaacgtagtaacgagaagtaagacgttaactcgtagttgggttacgttacgggacgggtaaggaaccgaggtaccgttacggaacccggtttacgtaggtaccgacggacccgaaggtcccgtacccgtccccgttaccgg

SEQ ID NO: 202072 - DNA, 526 bp, Homo sapiens
  misc_feature: GYAE6OF02F2VC2.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagagtactctagttgggtagttcgggacgggagggtaccgaaggcgtacggtacccgtcgtaggtcgagacccgaaggcctaccggcccccgttaccgg

SEQ ID NO: 202073 - DNA, 729 bp, Homo sapiens
  misc_feature: GYAE6OF02GQLWJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgactttaagttggtaaccaaacaaggaaacgaccaagggcccacgggccccccttaggttacgtttaaggtcggtaattaacgttaaagtaaaagaaccaacgttaggaaggaacgggaccccttacgaaggaagacttccccgtaggacgacggtactttcctcgtcggccttaccacgtctacggaaggggtaccaggaccgtagtaccgtaacggtttcgaacttacgtacgtaaggttacggaaacggttcccgaaagggaccgtaaggggaacgggaccggaagggtcgtaaggtaactttaacgttaacgtcgtaaccaaaacgtaggtaacgacgaaggtaacggtaacggttactaacgtagttaggggttcggttacgggacggggtaacgggaacccgaaggtacccgtacggtaacccggttaccgtaggttaccgaccggaccgtaaggcccgtaccggcccccgttaccggg

SEQ ID NO: 202074 - DNA, 549 bp, Homo sapiens
  misc_feature: GYAE6OF02JFY2C.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaagacactgagacggccctnagagactccctagagcgattctctggctccagctcgaggacagcagtcagttgactatcagtagagtcgagacagaggacgaggctagacttattatcgtacaaacgagtagacaaggtagacggtactacgtagttcgggtaggttacggacgggtagggaaccgtaacggtacgtaggaacccgtaccgttaggacgacggaccccgtaaggctacccggtcccccgtacgg

SEQ ID NO: 202075 - DNA, 768 bp, Homo sapiens
  misc_feature: GYAE6OF02JWW3Y.21.46.E02.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagactcatctacaggaaaggggtaggggtccgaggaggcgagaacgtctgggtggtcgtcaccatggcctggagtccctctacttctccccctcctccactctctcgcacacggctctgaggcctcctatgagctgacacacgcctaccctcggtgtcaggtcgtccccaggacagaccggcctagggatccaccgtgctcctgccagactgggactcgtaccaaaaggaaaattactggtacttagttacggtaacctaacgaagaacgaccgacggaccgacggaccccgtgtaggttaacgtgaagtacgtaataaagaccaacgtagagacggtccctanaacgagacgtccctagagtacgattcgtctaggcctaccgacgtctacgaacgggaacacggacgtagtacccgtacggttacgtaacttaacggtcgtaacgttacggtaaacgtcccggtaacggtacgaaacggtaacgggtacggaacggtaccggttactaaccgttacgttaaacttcgggtaacctaaaacggaacgttagggaaacctagggttaacgtacggggttaaactcggtttaaacggttacgggttaggtttaccgggacgggggtaaggtaaccggtaaaccgggttactacgggttaacccggaacgtttacggggtaccctaacgggtaacccggtacccggttaacggttccccgggtacccggttacccgg

SEQ ID NO: 202076 - DNA, 523 bp, Homo sapiens
  misc_feature: GYAE6OF02IB12G.21.46.E02.1.454.CMB.1.raw
  modified_base (417)..(417): a, c, t, g, unknown or other
  misc_feature (417)..(417): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctcagagatccctgagcgattctctggctccagctcgagggacagcagtcacgttgactatcagtgaagtcaggcagaggacgaggctagacttattactgtacaaanagtaagacagtagaggtactcgagttgggtagttcggacgggagggaccaaggctaggacccgttcgtaggtcgaacgcccgaaggcctaccggcccccgttccgg

SEQ ID NO: 202077 - DNA, 761 bp, Homo sapiens
  misc_feature: GYAE6OF02HAM0H.21.46.E02.1.454.CMB.1.raw
  modified_base (343)..(343): a, c, t, g, unknown or other
  misc_feature (343)..(343): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccacccgtcggtgtcagtcgtccccgaggacaggaccggccaggatccacctgctctgcagagtggactcgaaccaaaagaaatatgtactttagttacggtaccaacagaagccgacggccacggcccctgtgttacgtgatataataaacgacactgagacggccctagaganactcccgtagacgcgtatttcgtcgtggcctcgacgcctcggaacgggacacgaccgtacgttaccgtacgttacgaaccttactacgtaaggtaacgtaaccggttaccgaagggtaccgaaagggtaacggggaaccggagggtaccgttaacgggtaaacctttaagtttaaccgtaccggttaaaccgaaaacgtaaacggtaaccggtaacgtaaagggttaacgggtaacgggtttaaccgtaacggtttaggttacgggggtttaccgggttaccggggacggggtaacgggtaacccggtaacggttaccgttacccggggtaacccgtttaccgggtaaccgggttaccgaacccgggtaacccggtaaccgggtacccgttcccccggtacccccggtttaccccggg

SEQ ID NO: 202078 - DNA, 565 bp, Homo sapiens
  misc_feature: GYAE6OF02HN5YY.21.46.E02.1.454.CMB.1.raw
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaaacagaagccaggccaggcccctgtgttagtgaatatataaaagacactgagacggccctnagagactcctgagcgattcnctggctcagctacgagggacagcagtcacgttgactatcagtgaagtccgaggacaggaggacgaggctgacttatactgtacaanagtacgacagtagtaaggtactagtagttgggtagttcgggacgggacggggtaaccgaaggtaccgtacgggtacccgttaccgttaacggtcgaacccggaccccgtaaacgggtcctcccggtaccccccgttaccgg

SEQ ID NO: 202079 - DNA, 551 bp, Homo sapiens
  misc_feature: GYAE6OF02HN26V.21.46.E02.1.454.CMB.1.raw
  modified_base (412)..(412): a, c, t, g, unknown or other
  misc_feature (412)..(412): n is a, c, g, or t
tcagtcgtcgctcgcacgaccggtgctcgatttagactcatctacagggaaagggggtgggtccaggaggcagaactctgggtgtctcaccatggcccggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgcttattggtaccaacagaagccaggccaggcccctgtgttagtgatatataaagacactggagaggccctcagagatccctgagcgattctctgctccagctcaggacagcagtcacgttgactatcagtagaagtccaggcaggaggacgaggctagactattacngtacaaacgagtaagacgagtaagaggtaacttcgagttgggtgttcgggacgggagggaccgtaaggcgttacggacccgttaccgtagggtaccgacggaccccgtaaggcccgtaccggcccccgttcgggtaccc

SEQ ID NO: 202080 - DNA, 534 bp, Homo sapiens
  misc_feature: GYAE6OF02GHU6L.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagatccctgagcgattctcgtgctccagctcagggacagcagtcacgttgactatcagtgaagtccaggcaggaggacgaggctgactattactgttacaaacgagtagaacgagtagtaggtactcgtagttgggtagttcgggcgggaagggaccaaggtcgtcggacccgttacgtacggtacacggacccgaagggcctaccggccccgtaccgg

SEQ ID NO: 202081 - DNA, 533 bp, Homo sapiens
  misc_feature: GYAE6OF02FI9E1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtcgttagtgatatataaagacactgagaggccctcagagatccctgagcgattctctggctcagctcagggacagcagtcacgttgactatcagtgaacgtccagcagaggacgaggctagactattactgtacaaacagtagacagtagaggtactcgtagttgggtgttcgggacggagggaccgaagccgtacggacccgttaccgtaagggtcaacggtcccaagggtccctaccggcccccgttaccgg

SEQ ID NO: 202082 - DNA, 558 bp, Homo sapiens
  misc_feature: GYAE6OF02G6QV3.21.46.E02.1.454.CMB.1.raw
  modified_base (318)..(318): a, c, t, g, unknown or other
  misc_feature (318)..(318): n is a, c, g, or t
  modified_base (378)..(378): a, c, t, g, unknown or other
  misc_feature (378)..(378): n is a, c, g, or t
  modified_base (474)..(474): a, c, t, g, unknown or other
  misc_feature (474)..(474): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctgcagatggactgaccaaagaaatatggcttattggtaccaacagaagccaggccaggccccctgtcgttagtgatataataaaagacactgagacggccctnaagagactcccctgagcgattctctcggctccgagtctcagggacagtcagtccacgttnactatcagtagaagtccgagcagaggacgaaggctagactaattacgagttacaaactagtaagacgaagtagaaggttaactgtagttggggttnttccgggacggaggtacccgaaggtaccgtagacccggtaccgtggtaccgaggaccccgaaggcccgtcggccccctaccggg

SEQ ID NO: 202083 - DNA, 534 bp, Homo sapiens
  misc_feature: GYAE6OF02JA5SI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagacggccctcagagactcccgtgagcgattctctggctccagctcgagggacagcagtcacgttgactatcagtgaagtccaggcaggaggacgaggctagactattacgtgtaccaaagagtacgacagtagaggtactgtagttgggtgttcgggacggtaggaccgaaggcctacggtacccgttccgtaggtccgacggacccgaaggccctccgcccccgtcgg

SEQ ID NO: 202084 - DNA, 562 bp, Homo sapiens
  misc_feature: GYAE6OF02IR0QX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacagtctctgaggcctcctatgagctgacacagccaccctcggtctcagtgtccccgggacaaacggccaggatcacctgctctggagatgcattgacctaaaaaattattgtttttggaccagcagaagtcaggccaggcccctgtgttggtcatccatgaggacaggagacgacccgtccgggatcccctgagagattctctggctccaactcagggacggtgccacgttgattctcaggtcggggcccgagggtcgggaaggagtggaagcgtaggtaactacttacgttgttacctcagcagacagcaggtgtacagtcggagggggctagttcgggcgggacgggaccgaggttcgaccgttcgtaggtcacggcccaacggctcgcccccgtggtccacgtcctcgtccccgccctcctcccg

SEQ ID NO: 202085 - DNA, 533 bp, Homo sapiens
  misc_feature: GYAE6OF02FIDGM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgcctctgcagatggactgccaaagaaatatgcttatggtaccaacagaagccaggccaggccccctgtgttagtgatatataaagacactgagaggccctcagagatccctgagcgattctcgtggctccagcctcgagggacagcagtcacgttgactatcagtgaagtccaggcagaggacgaggctagactaattactgtacaaacgagtagacaggtagaggttacactagttgggtagttcggcggagggaccgaaggctacgacccgttccgtaaggtccacggaccccaagggcctaccggtcccccgttacgg

SEQ ID NO: 202086 - DNA, 755 bp, Homo sapiens
  misc_feature: GYAE6OF02IYTP6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtccagtcgtccccaggacagacggccaggatcacctgctctgcagatggactgacaaagaatatgacttattcggtaaccaacgagaacgcacggccgacgcccctggtgttagtgatataagtaagactactagagacggccctagagacgtactccgtagagtccgtagtttcctacgtcggtcctaccgtacggtaccgttacggaagggtaacctacggaccgaaacggtttccgtaacggttttacggaacctttaacgtaccgtaacggttacggtaaccggttaccggaacgggtaaccgaaagggacgggaaacccggtagggtacccgttacggttaacttaacggtttaacctaacgggttaaccgttaaaacgaacggttaaacgaaacgttaacgggttaaacgtacggtttaacgttccgttaaaggttccggggtttacggtttaccggggacggggttaaccggaacccggtaacggtaccgggtaccggtacccgttaccggttaacggtaccggtaaccgacccggttaacgggtcccgtaccgtccccccggttaccggg

SEQ ID NO: 202087 - DNA, 503 bp, Homo sapiens
  misc_feature: GYAE6OF02HL23K.21.46.E02.1.454.CMB.1.raw
  modified_base (312)..(312): a, c, t, g, unknown or other
  misc_feature (312)..(312): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (431)..(431): a, c, t, g, unknown or other
  misc_feature (431)..(431): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtacaacagaagccaggccaggcccctgtgttagtgatatataaagacactgagaggccctnagagactccctgagcgattctctggctccagctcaggacagcagtcacgttgactatcagtgaagtccaggcagagacgagctgactatactgacaaagagtananagtagagttactnaagttgggtgttcggacggaggaccgaagcgtcggaccgttcgagtcgacgcccgaaggctccgcccctcgg

SEQ ID NO: 202088 - DNA, 517 bp, Homo sapiens
  misc_feature: GYAE6OF02IY4PW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttagtgatatataaagacactgagaggccctcgagagatcccctgagcgattctctggctccagctcgagggacagcagtcacgtgactatcagtgaagtccaggcagaggacgaggctagactattacgtagtacaaacagtagacagtagagtactctagttgggtgtcggacggagggaccgaaggctcggaccgtcgtaggtcacgcccgaaggtctccggcccccgtcgg

SEQ ID NO: 202089 - DNA, 511 bp, Homo sapiens
  misc_feature: GYAE6OF02F4BYF.21.46.E02.1.454.CMB.1.raw
  modified_base (259)..(259): a, c, t, g, unknown or other
  misc_feature (259)..(259): n is a, c, g, or t
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaanagaagccaggccaggccccctgtgttagtgatatataaagacactgagaggccctcagagatcccctgagcgattctctggctccagctcgagggacagcagtcacgttgactatcagtgaacgtccgaggcaaggacggacgaggctgactattactgtacaaatagagagagtagagtactnagttgggtgtcggnggaggacgaagctggaccgtcgtagtcgacgccgaaggcctcgcccccgttcgg

SEQ ID NO: 202090 - DNA, 687 bp, Homo sapiens
  misc_feature: GYAE6OF02JVA3L.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcaggacgtagctacgaacgaaaagtaatacgttactacgttacggtaacgtaaccaaggaacgacggaccgacggacccgtacggtccgttaggttacggttagagtaattaagtaaacgaacactacgtaggaccgtaccgtacctagaagacgtaccgtacgaggacgtacgttacttcgtacgtccgtccaccgtacgtacggtacgggaacggacgacgtacgtacgtacgtacggtatactagtacgtaggtacgtaacgacggacgacggaaggaacgggacggtagtactagtaacttaacgttacgtaacgtaacgtaaacgagtaacgaagtaacggtaaggttacgtacgttacggtaggtttacggggtacggtacggggacggaacggtaccgagtcgtaaccgtaccggtacgacggtccgaacggtaccgtcggtccccgtcccggttacccgg

SEQ ID NO: 202091 - DNA, 751 bp, Homo sapiens
  misc_feature: GYAE6OF02IM47E.21.46.E02.1.454.CMB.1.raw
  modified_base (427)..(427): a, c, t, g, unknown or other
  misc_feature (427)..(427): n is a, c, g, or t
tcagtcgtcgctcgcacgaccggtgctcgatttagactcatctacagggaaagggggtgggtccgaggaggcagaactcgtgggtgtctcaccatggcctggactccctctacttcctcccctcctcactctctgcacaggctctgacggcctcctatgagctagaccacacgcccacccgtcggtgtcagtccgtaccccgaggacaggaccgccgacgggtactccaccgtcgcctcgtacgacgaagtcgtacggacctcggaaccaaaagtaactactgtacttagttacggtaaccaacgaacggaccgccgacggaccgaccggtcccgtggttacgttacgtagtaataataaagtaaacgacctagacggtacgaccggtccctagacgtacgtacctcgagacgtcgtactctcgtcnccgtacacgtcgtacggaacgtacgcgacgtacgtacgtacgtaacgtacgtacacggttagtaacggtaccgtacggacggtacggaacgggtacggaacggtacggttagtacgttaacgtttacgtacgtaacaacgtaacggttaacgtaacgtacgtaaggtacgggttaacgttacgtacggtttacggggtacggttttaccgggacggggtaccgggaaccggtaacggtaccggttacgaccggttacccgtaacgggtccctaacgggtcccctaaacgggtcccgtacgggttacccccgtacggttaccccg

SEQ ID NO: 202092 - DNA, 521 bp, Homo sapiens
  misc_feature: GYAE6OF02IWXOF.21.46.E02.1.454.CMB.1.raw
  modified_base (316)..(316): a, c, t, g, unknown or other
  misc_feature (316)..(316): n is a, c, g, or t
  modified_base (427)..(427): a, c, t, g, unknown or other
  misc_feature (427)..(427): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtgtcagtgtccccaggacagacggccaggatcacctgctctgcagatggactgaccaaaagaatatgcttattggtaccaacagaagccaggccaggcccctgtgttagtgatataataaagacactgagaggccctnagagactccctgagcgtattctctcggctccgagctcgagggacagcagtcacgttgactatcagtagacgtcaggcagaggacgaggctgactattactgacaacagtanacgagtagagtactctaggttggtagtcggacggaggaccaaggtctacggaccgttcgtaggtcacggacccgaggccgtccgccccgtccgg

SEQ ID NO: 202093 - DNA, 511 bp, Homo sapiens
  misc_feature: GYAE6OF02FW0NG.21.46.E02.1.454.CMB.1.raw
  modified_base (315)..(315): a, c, t, g, unknown or other
  misc_feature (315)..(315): n is a, c, g, or t
  modified_base (461)..(461): a, c, t, g, unknown or other
  misc_feature (461)..(461): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgcagatggactgccaaaagaaatatgcttattggtaccaacagaagccaggccaggccccctgtgttagtgatatataaagacactgagaggccctnagagatccctgagcgattctctggctccagctcgagggacagcagtcacgttgactatcagtgaagtccaggcagacgacggagcgtagacttatactgtacaaacgagtaagacgagtaaggagtactgagttgggtgttcgggnggaggacgagctcggaccgtcgtaggcacgccgaggctccgccccgtcgg

SEQ ID NO: 202094 - DNA, 581 bp, Homo sapiens
  misc_feature: GYAE6OF02JB72S.21.46.E02.1.454.CMB.1.raw
tcagtcgtcgctcgcacgaccggtgctcgatttagactcatctacagggaaagggggtgggtccaggaggcagaactctgggtgtctcaccatggcccggatccctctacttctccccctcctcactctctgcacaggctctgaggcctcctatgagctgacacagcccaccctcggtgtcagtgtccccaggacagacggccaggatcacctgctctgcagatggactgaccaaagaatatgcttattggtaccaaacagaagccaggccaggccccctgtgttagtgatatataagacactgagaggccctacagagatccctgagcgattctcgtggctccagctcgaggacagcagtcgtacgtttgacttatacgtagtagaacgtccgtaggacaggaaggacggaggtctagacttaattacgtagtaccaaacagtaagacctagtaagtaacggtacttacgtaagtttgggttacgttcgggtacggaggggtaaccgaaggtcgttacgacccggttaccgtaacggtcgacggacccgaggtccctaccggtaccccctcggttacccg

SEQ ID NO: 202095 - DNA, 514 bp, Homo sapiens
  misc_feature: GYAE6OF02G0IU3.21.46.E02.1.454.CMB.1.raw
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgccaaaagaaatatgcttattggtaccaacagaagccaggccaggcccctgtgttagtgatataataaagacactgagaggccctacagagactccctgacgcgattctcgtggctccagctcgagggacagcagtcagttgactatcagtgaagtccaggcagagacgaggctgactatactgtacaaanagtagagagtagaggtactcgtagttgggtgttcgggcggtagggacctaggctcggaccgtcgaggtcacggacccgagctccgccccgtcgg

SEQ ID NO: 202096 - DNA, 689 bp, Homo sapiens
  misc_feature: GYAE6OF02JRV3J.21.46.E02.1.454.CMB.1.raw
  modified_base (293)..(293): a, c, t, g, unknown or other
  misc_feature (293)..(293): n is a, c, g, or t
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctgcagatggactgaccaaaagaaatatgacttagttggtaaccaacagaagccaggccaggcccctgtcgttagngtatatataaagacatgagaggccctanagagactcccgagacgcgtaatttcctacgtggcctaccaggtccgtacgaacggggactaggaccacggttacctacggtttagaaccgttaagtcgaaggttacgaaacggttacccgaagggacaaacgggagggaaaccggagggtaccttagggtaaccttaacgtttaacgtacgttaaaccgaaaacgttaaggtaacgaaaccgtaaagggttaacggaacggtttaacttacggtaaacggtttggggttacgttaccggggacgggtaacgggtaacccgaagggtccgtacggtaacccggtacgttacgggaccgtacggaacccgaacggtcccgtaccggccccccgttaacgg

SEQ ID NO: 202097 - DNA, 544 bp, Homo sapiens
  misc_feature: GYAE6OF02IRBJU.21.46.E02.1.454.CMB.1.raw
  modified_base (319)..(319): a, c, t, g, unknown or other
  misc_feature (319)..(319): n is a, c, g, or t
  modified_base (481)..(481): a, c, t, g, unknown or other
  misc_feature (481)..(481): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgactttattggtaccaacagaagccaggccacggcccctgtgttagtgatataataagacactgagacggccctnagagatccctgacgcgtattctctggcctccagctacgagggacagcacgtcacgttgactatacgagtgaagtcgaggcaagaggacgaggctagacttattacgtgtacaaacgagtagagagtaggaagttacgtcgtagtttagggtacggtacgggnggacgggacaaggtaccgtggtaccgtacgtggtacgacgaccgaggcctaccgcccctacgg

SEQ ID NO: 202098 - DNA, 581 bp, Homo sapiens
  misc_feature: GYAE6OF02FGYG8.21.46.E02.1.454.CMB.1.raw
  modified_base (241)..(241): a, c, t, g, unknown or other
  misc_feature (241)..(241): n is a, c, g, or t
  modified_base (395)..(395): a, c, t, g, unknown or other
  misc_feature (395)..(395): n is a, c, g, or t
  modified_base (471)..(471): a, c, t, g, unknown or other
  misc_feature (471)..(471): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgactttattggtaaccaactagaagccaggccaagggccccctggtcgttagtggatatataaaaggaccaactggaagacgggcccctcgagacgatcccctgacgtcgatttctctggctccagctcagggtcagcagtcacgttgactancagtgaagtccaggcaggaggagaggctagactattactgtacaaactaggtaacgactaggtagtaggttacctntacgtttggggtctttacgggcggtaacgggtacccgaaggtccttaggtaaccccggttcgttaacgggtcgacggtacccgaagggtccctacggtcccccttacggg

SEQ ID NO: 202099 - DNA, 558 bp, Homo sapiens
  misc_feature: GYAE6OF02GFF0A.21.46.E02.1.454.CMB.1.raw
  modified_base (291)..(291): a, c, t, g, unknown or other
  misc_feature (291)..(291): n is a, c, g, or t
  modified_base (318)..(318): a, c, t, g, unknown or other
  misc_feature (318)..(318): n is a, c, g, or t
  modified_base (430)..(430): a, c, t, g, unknown or other
  misc_feature (430)..(430): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaaacgagaagccaggccaggcccctgtcgttagngatataataaagacatgagaggccctnagagatccctagagcgattctctggcttccagctcgagggacagcagtcacgttgactatcagtgaacgtccaggcaggacggacgaggctagaacttattactgtacaaanagtagacaaggtagacggttactctaagttgggtgttacgggcgggtacgggaaccgaagggtccgttaggaccccggttacgttaggtcctacggacccgaaggccgttacccgcccccgttaccgg

SEQ ID NO: 202100 - DNA, 518 bp, Homo sapiens
  misc_feature: GYAE6OF02IBDD5.21.46.E02.1.454.CMB.1.raw
  modified_base (287)..(287): a, c, t, g, unknown or other
  misc_feature (287)..(287): n is a, c, g, or t
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
tcagtcgtcgctcgcacgaccggtgctcgatttagactcatctacagggaaagggggtgggtccaggaggcagagctctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaaacagaagccaggccaggcccctgtgttagngatatataaagacactgagacggccctcgagagactccctgagcgtattctcgtggctccgagctcgaggacagcagtcacgtgactatcgagtnaacgtcaggacagaggacgaggctagaactattactagtacaaacagtanacgagtagaggtacngtagttgggttgtcggacggaggaacaagctagaccgttcgtaggtcacgcccgaaggtcctacgtccccg

SEQ ID NO: 202101 - DNA, 728 bp, Homo sapiens
  misc_feature: GYAE6OF02HBG8U.21.46.E02.1.454.CMB.1.raw
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (357)..(357): a, c, t, g, unknown or other
  misc_feature (357)..(357): n is a, c, g, or t
  modified_base (368)..(368): a, c, t, g, unknown or other
  misc_feature (368)..(368): n is a, c, g, or t
tcagtcgtcgctcgcacgaccggtgctcgatttagactcatctacaggaaaggggtagggtccgaggaggcgagaactctgggtgtctcaccatggcctggatcctctacttctcccctcctcactctctgcacaggctctgaggcctcctatgagctgacacagccaccctcggtgtcagtcgtccccaggaccagaccggccaggatccacctgctctgcagatggaactgaccaaaagaaactntgacttattggtaaccaaacagaacgaccaggccaaggccccctggtnttagngaattataagtaaaagaacacttagaagaggccccttagagaacgactccctaggancgaacttttcnccgtgggccttccgaagtcctcggaaaggaccgtagcgttaacggtctaacggtttacgattacgtacgtaaggtacgtaaagttacccgaagggtacgaacggaaacgggaacggaacgggtacggttaacgtaaccgtaacgtttaacgtacggttaaacaaaaccgtaagggttaaacgtaaccgtaaaggttaaacggtaacgggttaaccttaaccggtaagttacggggtttaacgtttccggggtaacgggtaacgggggtaaccctaagggaccggttccgtaacccggttaccggtacggttaaccgacgggtaacccgtacggtaacgtccccggtaccccgttacccgg

SEQ ID NO: 202102 - DNA, 565 bp, Homo sapiens
  misc_feature: GYAE6OF02HEPHR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggatcacctgctctgcagatggactgaccaaagaaatatgcttattggtaaccaacagaagccaggccaggcccctgtcgttagtgatatataaagacactgagacggccctacagagactcccgtagacgcgacttctcgtggcctccagctcgagggacagcagtctacgtagacttatcagtgaacgtccgaggcaggaggacgaggctagacttattacgtgtaacaaacgtgtaagactagtaagtaacgtactagtaggttcgggtcgttacggacgggaggaccgaagtcgtacggtaccgtacgttacggtcgacggtaccccgtaaggccctaccggtcccccgttaccgg

SEQ ID NO: 202103 - DNA, 662 bp, Homo sapiens
  misc_feature: GYAE6OF02JTJD0.21.46.E02.1.454.CMB.1.raw
  modified_base (224)..(224): a, c, t, g, unknown or other
  misc_feature (224)..(224): n is a, c, g, or t
  modified_base (274)..(274): a, c, t, g, unknown or other
  misc_feature (274)..(274): n is a, c, g, or t
  modified_base (415)..(415): a, c, t, g, unknown or other
  misc_feature (415)..(415): n is a, c, g, or t
  modified_base (577)..(577): a, c, t, g, unknown or other
  misc_feature (577)..(577): n is a, c, g, or t
tcagtcgtcgctcgcacgaccggtgctcgatttagactcatctacagggaaagggggtaggggtccgaggaggcgagaactctgggtgtctcaccatggcctggatccctctacttctcccctcctcactctctgcacaggctctgaggcctcctatgagctgacacagtccaccctcggtcgtcagtcgtccccaggacacgacggccaggtatccacccgtncctctcgcagattggactgaccaaaagaatatgacttagtcggtaacaanagagaccacggccaggcccctgtgttactgactataataaagaccacgtgtaacggacggtacccctgaagtacgaacttccccgtggaacgtcgaactttctccgttcgaccttcccgaagccttacggaagggtaaccnggacctacggtcgtacgttacggacttactacgagtcgaacgtaccgaggactaggaacggtacgaggtactagtacttaactacttagaacctaacgtaagtaacgacgtaaacgtaagtacggttaacctacgttaggtttaacgggtgttaacccgggnggtaacgggacgtaacggtccgtacggtacccgttagtaccggttacgacccggtaccgtacggacgttaccgtaccccgtacgg

SEQ ID NO: 202104 - DNA, 552 bp, Homo sapiens
  misc_feature: GYAE6OF02GQF53.21.46.E02.1.454.CMB.1.raw
  modified_base (319)..(319): a, c, t, g, unknown or other
  misc_feature (319)..(319): n is a, c, g, or t
  modified_base (390)..(390): a, c, t, g, unknown or other
  misc_feature (390)..(390): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttaattggtaaccaacagaacgccaggccaaggcccctgtgttagtgatatataaagacactgaagacggccctnagagactccccgtagacgtcgatttcctacgtcggcctccagctacgaggacagcagtcacgttgactatnagtgaagtccaggcaggaggacgaggctagacttattacgtgtacaaatagtaagactagtaggtacgtactgtaggttgggtgttcgggacggacgggaaccaggcctaggacccgttccgtaggtaccacggcccgaacggccgtaccgtccccgtccgg

SEQ ID NO: 202105 - DNA, 515 bp, Homo sapiens
  misc_feature: GYAE6OF02GSS49.21.46.E02.1.454.CMB.1.raw
  modified_base (368)..(368): a, c, t, g, unknown or other
  misc_feature (368)..(368): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctttgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggcctcagagatccctgagcgattctctggctccagctcagggacagcagtcacgttgactntcagtgaagtccaggcagaggacgaggctgactagttactgtacaaanagtaganagtagagtacnctagttggtgttcggcggaggacgaaggctaggaccgtcgtaggtcgacggtaccgaaggctcggtacccccgtgtacccg

SEQ ID NO: 202106 - DNA, 536 bp, Homo sapiens
  misc_feature: GYAE6OF02FOT6O.21.46.E02.1.454.CMB.1.raw
  modified_base (260)..(260): a, c, t, g, unknown or other
  misc_feature (260)..(260): n is a, c, g, or t
  modified_base (454)..(454): a, c, t, g, unknown or other
  misc_feature (454)..(454): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaanagaagccaggccaggccccctgtgttagtgaatatataaagacactgagaggccctcagagatcccgtgagcgattctctggcttccagctcgagggacagcagtcacgttgactatcgaagtgagtccaggtacaggaaggacgaggcgtgacttattacgtagtacaaacgagtagacaagtagagttactntagttggtgttcgggcggaggaccgtaaggctcggaccgttccgtaggtaccacggacccgaaggcctcgtcccccgtacgg

SEQ ID NO: 202107 - DNA, 519 bp, Homo sapiens
  misc_feature: GYAE6OF02GVAKD.21.46.E02.1.454.CMB.1.raw
  modified_base (241)..(241): a, c, t, g, unknown or other
  misc_feature (241)..(241): n is a, c, g, or t
  modified_base (315)..(315): a, c, t, g, unknown or other
  misc_feature (315)..(315): n is a, c, g, or t
  modified_base (367)..(367): a, c, t, g, unknown or other
  misc_feature (367)..(367): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgatatataaagacactgagacggccctanagagactccctgagcgattctctggctcagctcgaggacagcagtcacgttnactatcagtgagtcaggcaggaggacgaggctagactattactgtacaaacagtagactagtagagttactcgtagttgggtgtcgggcggtacgggaccgaaggcctggacccgtacgtaggtccacggcccgaaggcctcgccccgtcgg

SEQ ID NO: 202108 - DNA, 553 bp, Homo sapiens
  misc_feature: GYAE6OF02GVPQA.21.46.E02.1.454.CMB.1.raw
  modified_base (315)..(315): a, c, t, g, unknown or other
  misc_feature (315)..(315): n is a, c, g, or t
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaaagacactgagaggccctnagagatccctgagcgattctctggctccagctcgagggacagcagtcacgttgactancagtgaagtccaggcaggaggacgaggctagactattacgtgtacaaacagtaagacgtaaggtaggaagtacttgaagtttggggtcgtttacgggacggtagggaccgaaggtcgtacggacccggttaccgtaggtaccgacggaccccgaaggcccgttccgccccccgttaccgg

SEQ ID NO: 202109 - DNA, 635 bp, Homo sapiens
  misc_feature: GYAE6OF02JZ6PR.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtagggtccgaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgccagatggactgaccaaagaatntgcttattggtaccaacagaacgaccaggccgaggcccctaggtcgttagtgactataataaagactactaggagacgccctcgaagagactcctgacgcgattcactggactccagcgtcagggacagcagtcacgttagactatccgtagtgaacgtaccagggtaccagggacggtacggaacggtcgtacgaacgttagttaacctaggttaaccaaaacgtagtaaggacctaaaggttaaggtaacgttaacctaggtaagtttggggttaccgtttacggggacggtaacggggaacccgaaggtacttccgggtaacccgttacggttaaccggtcggtaacggtaccccggaaacggtcgtaccccggtccccgttaacccggg

SEQ ID NO: 202110 - DNA, 566 bp, Homo sapiens
  misc_feature: GYAE6OF02FPRPS.21.46.E02.1.454.CMB.1.raw
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggactcacctgcctctgcagatggactgaccaaagaatatgcttattggtaccaacagaagccaggccaggcccctgtgttagtgatatataaagacactgagaggccctnagagatccctgagcgattctcgtggcctcagctcgagggacagcagtcacgttgactatcagtnaagtcaggcagaggacgagcagactatactaggtacaaacagtaagacaaggtagaggttactacgtaggtttgggtcgtttacgggacgggtagggaacccgtaaggtccgtacggtaccccggttacgttacgggtaccgaccggtacccgaaagggtcccgttccggaccccccgtttacccggg

SEQ ID NO: 202111 - DNA, 565 bp, Homo sapiens
  misc_feature: GYAE6OF02HD1C9.21.46.E02.1.454.CMB.1.raw
  modified_base (241)..(241): a, c, t, g, unknown or other
  misc_feature (241)..(241): n is a, c, g, or t
  modified_base (374)..(374): a, c, t, g, unknown or other
  misc_feature (374)..(374): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgatatataaagacactgagaggccctcagagactccctagagcgatttcctctggcctccgagtctacgagggacagcagtcacgttnactatcagtgaagtccaggcaggaggagaggctagactagttactgtaacaaacagtaagaacgtaagtaagagttactcgtaaggtttgggtcggttcgggacgggaacgggaccgtaaggcgtacggtaaccgttaccggtacgtaccgaccgtacccggaacggtccgtcccggtcccccgttaccgg

SEQ ID NO: 202112 - DNA, 571 bp, Homo sapiens
  misc_feature: GYAE6OF02IKUAH.21.46.E02.1.454.CMB.1.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgctttagttaggtaaccaagaagaacgccaggcccaggccctgtgttagtgatataataaagcacgtgagacgcctnagatactcctgagcgtattccngtgcctcngctcgagggacagcagtccacgttnactatacgagtagacgtcgagacgaggacggacgaggctagtactattacgtgaacctaaagagtaacgacgtaagtaggtacgtacctagtaggtttgggtacgttccgggacgggtaacgggaccgtaagccgtacggtacccgttacgtaacggtcgaccggtacccgtaagggccctccggtcccccgtcgg

SEQ ID NO: 202113 - DNA, 793 bp, Homo sapiens
  misc_feature: GYAE6OF02HKI1H.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacaggacggccaggactcacctgctctgcagatggactgaccaaaagaatagtgtacttagttacggtaaccaaacgaaggaacgaccgacggaccgacgggtcccccttaggttacgtttacggtacgtaattaattaaagttaaaaacggaactaaccgttaggaacggtaacggacccccgttacgaacggtaacggtaaccttacccccgttaggaaacggtccggtaaacttttcccgtaccgttcgggtaccttcccgaacggtaccgtaacggacgggaactacggacgtacgtacgtaccggtttacgaacgttaagtacgtaacggtacgtaaacggttccggaacggacggtaacgggaacgggaacggacgggttaccgttaacggtaaccgttacgttaacgtaacgtaccgtaaaaaggtacgttaacggtaaccgtaaggttaacggtaaggttaaccgttacggtaaagtttcggggtcgttacggggacggggaacggtaacccggaaggtcccgtacggtaccggttaccgtacggtaccggtaacgtacccggaacggtcccgtaccgtccccgttaccggg

SEQ ID NO: 202114 - DNA, 517 bp, Homo sapiens
  misc_feature: GYAE6OF02F0J8I.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgcttattggtaaccaacagaagccaggccaggcccctgtgttagtgatatataaaagacactgagaggccctacagagatccctgagcgattctctggctccagctcgaggacagcagtcagttgactatcagtgaagtccaggcagaggacgaggctagactattactgtacaaacgagtagacaagtagagtactcgtagttgggtcgttgggcggacggacgaacgctacggaccgttcgaggtacacgaccgaggctcgccccgtacgg

SEQ ID NO: 202115 - DNA, 530 bp, Homo sapiens
  misc_feature: GYAE6OF02HI8JF.21.46.E02.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatggactgaccaaagaaatatgtcttattggtaaccaacaagaagccaggccaggcccctgtgttagtgatatataaagacactgagaggccctanagagactccctgacgcgtattcctctggctccagctcgagggcagcagtcacgttgactatcagtagagtccaggcaggaggacgaggcgtacgacttattactagtacaaagagtacgacgagtacgagtactgagtttgggtagttccgggaggacgggacaggcgtcggaccgtcgtaggcacgccaaggccttccgccccttacgg

SEQ ID NO: 202116 - DNA, 633 bp, Homo sapiens
  misc_feature: GYAE6OF02IWF5X.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgctatggtaccaacagagcaggccaggcccctgtgttagtgataatataaagacactgagacggccctcgagagactccctggagtcgagtttcctcgtacggctacccgtacgcgtaccgaggggaccaggaccagttccgaacgttgacttacgtccgagttacggaacgtccgaaggtcgacggtagggacgtagggacttacgaccttagttaaccttacgtacgaaacgtacggtaagactaagggtagtaacgggttaacctcgtacggttggggttacggttacgggacgggtaacgggaccgtaacggaccgtacgtacccggttacgtacggtaccgtaaccggaccccgaagggtacccgttccggtccccccgttaccggg

SEQ ID NO: 202117 - DNA, 525 bp, Homo sapiens
  misc_feature: GYAE6OF02JAZC7.21.46.E02.1.454.CMB.1.raw
  modified_base (427)..(427): a, c, t, g, unknown or other
  misc_feature (427)..(427): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgccagtgtccccaggacagacggccaggatcacctgctctgcagatggactgaccaaagaaatatgcttattggtaaccaacagaagccaggccacggcccctgtgttagtgatatataaagacactggagaggccctcagagactccctggagcgtattctctggctccagctcgagggacagcatctacgttgactatcagtgaacgtcaggtcaggacggacgaggctagactagttactgacaaangtagacagtagagtactcgagttgggtgttcgggacgagggaccaggtcgtcggaccgttcgtaggtcacgacccgaaggtccgtacgccccgttacg

SEQ ID NO: 202118 - DNA, 521 bp, Homo sapiens
  misc_feature: GYAE6OF02F13NT.21.46.E02.1.454.CMB.1.raw
  modified_base (313)..(313): a, c, t, g, unknown or other
  misc_feature (313)..(313): n is a, c, g, or t
  modified_base (420)..(420): a, c, t, g, unknown or other
  misc_feature (420)..(420): n is a, c, g, or t
  modified_base (461)..(461): a, c, t, g, unknown or other
  misc_feature (461)..(461): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtccaggcaggaggacgagcgtgactattactagtacaaacngtagacgaggtaagtaggtacttcgagttgggtgttcgggnggaggacgaaggcgtacgaccgttcgtaggtcacgacccgaaggcctacgccccgtacgg

SEQ ID NO: 202119 - DNA, 531 bp, Homo sapiens
  misc_feature: GYAE6OF02JC2M6.21.46.E02.1.454.CMB.1.raw
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggccccctgtgttagtgataatataaagacactgagacggccctcagagactccctgagcgattctctggctccagctcgagggacagcagtcacgttgactatcagtgaagtccaggcaggagacgaggctgactattactagtacaaanagtagaacagtagagtactcgtagttgggtgttcggcggaagggacctaaggacctggtacccgtcgttacggtcacggtacccgaaggcctccggcccccgttacgg

SEQ ID NO: 202120 - DNA, 690 bp, Homo sapiens
  misc_feature: GYAE6OF02JKU9N.21.46.E02.1.454.CMB.1.raw
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgcagatggactgaccaaaagaaatntgacttattggtaaccaacagaanccgaaggccaggcccctgtgtacgtgataatataaagacacgtgagacgccctagagagactcccgtagagcgtattcctcgtaggcctaccgagctacgagggacctagacgtacgtcgtaacgttcgaaccttagtacgaaggttacggaaacggttcccgaaaggtaccggaaagggtaacgggaaccggaggtacgtacgtaaacgttacgtttaaccgttagtaaccaaaacgtaaggtaacgaacgtaagggttaaacggtaacggttaacttacggtaacggtttaggggtacgggtttaccggggacgggtaaccggggtaaccgaaacggtacgtaccgggtaacccgttacccgtaagggttaccgacccgggtaccgaaccggtaccgtacccggtaccccccggttaaccgg

SEQ ID NO: 202121 - DNA, 546 bp, Homo sapiens
  misc_feature: GYAE6OF02GDZSW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagaggccctcagagatccctgagcgattctctggcctcagctcgagggacagcagtcacgttgactatcagtgaagtccaggcagaggacgaggctgacttattactgtacaaacgagtagacagtagacgttactactagttgggtgttcgggacgggtaagggaccgtaaggccgtacggtaaccgttccgtaaggtacgacggtacccgaaggtccgttacccggcccccgttaccggg

SEQ ID NO: 202122 - DNA, 552 bp, Homo sapiens
  misc_feature: GYAE6OF02IGGIZ.21.46.E02.1.454.CMB.1.raw
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
  modified_base (384)..(384): a, c, t, g, unknown or other
  misc_feature (384)..(384): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtgtcagtgtccccaggacagacggccaggatcactgctctgcagatggactgaccaaagaaatatgacttattggtaaccaacagaacgccaggccaggcccctgtcgttagtgatataataaagacatgagacggccctnagagactcccngagcgtattctctggctccagctcgagggacagcagtcacgttgactatcagtnaacgtccaggcaaggaggacgaggtctagtacttaacttactcgtaactaaanggtaanacgaagtaggtacgtactacgtagttggggttgttaccgggagggaacggacgaaggtcgtacgtacccgtcgtaggtcacggaccgaacggtctcccgcccgtcccgg

SEQ ID NO: 202123 - DNA, 668 bp, Homo sapiens
  misc_feature: GYAE6OF02JS907.21.46.E02.1.454.CMB.1.raw
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtaggggtccgaggagggcagaactctgggtgtctcaccatggcctggatccctcctacttctcccctcctcactctctgcacaggctctgaggcctcctatgagctgacacagccaccctcggtgtcagtcgtccccaggacacgacggccaggatccacctgctctgcagatggactggaccaaaagaaatgtagtcttattaggtaccaacaagacgaccacggaccgacgtaccccgtgttcgttacgtaggactataataaaagacaacgtgaagacgaccctacacgagactacccgtagacgtacggtacttcgtccgttcggccgtaccacgtccgtacgacggaccacgcgtacgtactaccgttacgattacnctagtacgacgtacgaggacgtaggacgacggtcggtacgtagtacgttacgttagtacgtaccaaagtaacgacgaactaggaacgtacgtaactacgttaacggttgggttaccggttcgggacgggtagggaacccgtaggtaccgttacgggacccgtttacgggtaccgttacccaaccgggtacccgaaccgggtacccgttcccggtacccccggttaccgg

SEQ ID NO: 202124 - DNA, 825 bp, Homo sapiens
  misc_feature: GYAE6OF02HJ997.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagctgacacacgcccaccctcggtgtcagtcgtccccaggacagacggccaggactccacctgctctgcagatcggactagaccaaaataaatatactactttaagttacggtaaccaaacgagaaaccgccgacggaccacggcccctggttacggttagtacgtaattaataaacgttaaaacgacgtacgttaggaacggaccggtacccctagaacggaacgtaactccccgtaggaactcggtactttcgtcgtcggctaccgacgtacgtccggaagggaaccgagacgtaacggtttcgaacgtttagacgttaatccgtaaggtacgaacgtaccgaaggggtacgaacggaaacgggaaccggtaacggtccgtaacggtaacgtttaactttaacgtacggttaaaccttaaaacggaacggttaaaccggtaaaccgtaaagggttaaccggtaaacggtttaaccgttaacggttaacgggtttcggggttaacggggtttcccgggaaccgggggtaaacggggggaaacccttaacgggtacccgggtacggttaaccccggttacccgggtaaaccggttccggaacccgggaacccccggttaaaccggggtccccgtaccccccggggtttaaccccccggtttacccggg

SEQ ID NO: 202125 - DNA, 514 bp, Homo sapiens
  misc_feature: GYAE6OF02GL8OW.21.46.E02.1.454.CMB.1.raw
  modified_base (314)..(314): a, c, t, g, unknown or other
  misc_feature (314)..(314): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgccaaaagaaatatgcttattggtaccaacagaagccaggccaggcccctgtgttagtgatatataaagacactgagaggccctnagagatccctgagcgattctctggctccagctcgagggacagcagtcacgttgactatcagtgaagtccgagcgagaggacgaggctagacttattacgngtacaaacagtanacgagtagaagtactcgagttgggtgttcggcggaggaccgaagcgtacgaccgtcgtaggtcacgcccgaggcctcgccccgtcgg

SEQ ID NO: 202126 - DNA, 549 bp, Homo sapiens
  misc_feature: GYAE6OF02G57W2.21.46.E02.1.454.CMB.1.raw
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtacaacagaaagccaggccaggcccctgtcgttagtgatatataaagacactgagaggccctnagagactcccctgagcgtatttcnctggctccagctacagggacagacagtcacgttgaactatcagtagaagtccagcagaggacgaggctgatattacntacaaanagtaagacaagtagagtatcgagttgggtgtacgggcggaagggacccaaaggtccgtacggtacccggttacgtacgggttaccgaacggaccccaaagggtcctacccggcccccgttacccgg

SEQ ID NO: 202127 - DNA, 541 bp, Homo sapiens
  misc_feature: GYAE6OF02F5M3T.21.46.E02.1.454.CMB.1.raw
  modified_base (316)..(316): a, c, t, g, unknown or other
  misc_feature (316)..(316): n is a, c, g, or t
  modified_base (432)..(432): a, c, t, g, unknown or other
  misc_feature (432)..(432): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgcctctgcagatggactgaccaaaagaaatatgcttattggtaaccaacagaagccaggccaggcccctgtgttagtgatatataaagacactgagaggccctnagagatcccctgagcgattctctggcttccagctcgaagggacagcagtcacgttgactatcagtgaacgtaccaggcaaggacggaggaggctaggactattactgtacaaaacngtaagacgagtaagagtactctaagttgggtgttcgggcgggagggaaccgaaggtcgtacggacccgtcgtaggtcaacggcccgaaggccgtcgcccccgttaccgg

SEQ ID NO: 202128 - DNA, 633 bp, Homo sapiens
  misc_feature: GYAE6OF02I3FUD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtgtccccaggcagacggccaggatcacctgctctgcagatggactgaccaaaagaaatatgtcttattggtaaccaacgaagaagccaggccacggcccctggtcgttagtgatatataaaagacacgtgagacggccctcagagactcccgtgagccgtatttcctcgtcggctccgacgtctcgaggggacaggtcggccctaccgtttacgactagtcgacggtcggggcccgtagggtcggacggagtaggaacgtcgtagactttacgttagtttgttaccgaccaccgaactacgtagttaggtcggtacacgttcggtaaggggttacgttaccgggacgggtacgggaccgtaaggttacggtacccggttccggttacggtccgacggtcccggaacggtcccgtccggtcccccgttcgggttaccctaccgtttccccg

SEQ ID NO: 202129 - DNA, 713 bp, Homo sapiens
  misc_feature: GYAE6OF02F11HZ.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagagtgactgaccaaaagaaatntcgtactttagttacggtaaccaagaagaacgaccgacggaccgaaccggtccccttaggttagttaggtagtaattaataagtaaaacgacctacgtaggaaggaccggtccctagaaggagtaccttcccgaggtacgaccgtactttccgtcgtacggtcctacccgagtccgtacggacggggaacacgacgtaacggtccgtaacggtttacgtaaccttagtacgtaagggtaacgtaaaccggttccggaaggtacgaaggggtaacgggaacggacgggtacctacggtaacttaacgtttacgtacgtaaccaaacgtaaggtaacgaacgtaggtaacgtagttacctagtacggtttggggtacgttcgggacgggtaacgggaccgaaggtcgtaccgggtaccgttaccggtaggtaccgacgtaccccggaggtcccgtcccggccccggttaccgg

SEQ ID NO: 202130 - DNA, 506 bp, Homo sapiens
  misc_feature: GYAE6OF02FT13D.21.46.E02.1.454.CMB.1.raw
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
  modified_base (421)..(421): a, c, t, g, unknown or other
  misc_feature (421)..(421): n is a, c, g, or t
  modified_base (440)..(440): a, c, t, g, unknown or other
  misc_feature (440)..(440): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggccccctgtgttagtgatatataaagacactgagaggccctnagagatccctgagcgattcnctggctccagctcagggacagcagtcacgttgactatcagtgaagtccaggcaggaggacgaggctagactattactgtacaaacngtagacagtagaggtactnagttgggtgttcggcggaggaccgaagctagaccgtccgtaggtcagcccaaggctcgcccctcgg

SEQ ID NO: 202131 - DNA, 502 bp, Homo sapiens
  misc_feature: GYAE6OF02FR1K5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaaagacactgagaggccctcagagatcccctgagcgattctctggctccagctcagggacagcagtcacgttgactatcagtgaagtccaggcagaggacgaggctgactatactgtacaaacagtagacagtaagagtactgattgggtgttacggcggagggaccgaagcgtgaccgtcctaggcagcccaaggctcgcccctcgg

SEQ ID NO: 202132 - DNA, 562 bp, Homo sapiens
  misc_feature: GYAE6OF02GSBU1.21.46.E02.1.454.CMB.1.raw
  modified_base (376)..(376): a, c, t, g, unknown or other
  misc_feature (376)..(376): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactttctgcacagtctctgaggcctcctatgagctgacacagccaccctcggtgtcagtgtccccaggacaaacggccaggatcacctgctctggagattcattgaccaaaagatatacttgttggttccagcagaagtcaggccaggccccctgtactggtcatccatgaggccagtcgacgacactccgggactcccgtgagagattctctcgccctccagctcgagggacaggtcggccacttgactancaggtggggcccaggtggacgatgaagctagactactattgttacgcaccgagacagtagtggtcatcggagggggttattcgggcgggagggaccgtaagttcgaccgttcgttcggtacgacgacccgaggccgtccgcccccgttcggtcctaccgttccgtccggttccccgcccttccccg

SEQ ID NO: 202133 - DNA, 580 bp, Homo sapiens
  misc_feature: GYAE6OF02JCHTC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctcagagactccctagagcgatttcctcgtggcctccgagctcgagggacagcagtcacgttgactatcagtagaacgtccgaggcaggaggacgaggctgacttattactgtaacaaactagtacgacgtagtaagtagttacctagtacggtttgggtcgtttacgggacgggtaacgggaaccgaaggtcctacgggtaacccgttccgtaacggttacccgacggttaccccggaaggtcccgttacccggccccccgttaccggg

SEQ ID NO: 202134 - DNA, 521 bp, Homo sapiens
  misc_feature: GYAE6OF02GKWK4.21.46.E02.1.454.CMB.1.raw
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (464)..(464): a, c, t, g, unknown or other
  misc_feature (464)..(464): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttagttggtaccaacagaagccaggccaggcccctgtgttagtgatatataaagacactgagacgccctgagagactccctagagcgtatctcgtaggcctccgagctcgagggacagcagtcgacgtgactatcagtgaagtccgagcgagagacgaggctagtactattatagtacaaacgtagtaganagtaggtagtactnagttggtagttcggnggacggacgaagtcgtacggaccgtcgtagtaccagaccgagcgtccgcccgtccgg

SEQ ID NO: 202135 - DNA, 574 bp, Homo sapiens
  misc_feature: GYAE6OF02G53E8.21.46.E02.1.454.CMB.1.raw
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgtcttagttcggtaaccaaacgagaacgccaggcccacggcccctgtcggttagtgtatataataaagacacgtgaagcggaccctanagagactcccngagcgtattcnctgctcagctcgaggacagcagtcacgttnaactntcagtgaacgtccgaggacaggacggacgaggtactgactattacgtacgtaacaactggtaacacgtaagtaggacgttactagtagttgggtacgtccggagggtacggaaccgaaggtccgtacggtacccgttccgtaggtccaacggccccgaagggtccctaccggcccccgttaccgg

SEQ ID NO: 202136 - DNA, 288 bp, Homo sapiens
  misc_feature: GYAE6OF02FPTV2.21.46.E02.1.454.CMB.1.raw
  modified_base (258)..(288): a, c, t, g, unknown or other
  misc_feature (258)..(288): n is a, c, g, or t
tcagtcgtcgctcgcacgaccggtgctcgatttagactcatctacagggaaaggggactggagtggttattattcctcggggccaggggaacccctggtaaccgtctccctcagcctccaccaagggcccatccggtcttcccccctgaccgccctgcctccaggagcacctccgagagcacagcggccctgggctgcctggtcaaggactacgttccctgtctcctacctgacgcgggctgggcaagggcgcatagnnnnnnnnnnnnnnnnnnnnnnnnnnnnnnn

SEQ ID NO: 202137 - DNA, 564 bp, Homo sapiens
  misc_feature: GYAE6OF02GMST7.21.46.E02.1.454.CMB.1.raw
  modified_base (258)..(258): a, c, t, g, unknown or other
  misc_feature (258)..(258): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaanagaagccaggccaggcccctgtcgttagtgatatataaagacactgagaggccctcagagatcccctagacgcgattctctggcctccagctcgaggacagcagtcacgttagactatcgagtgaacgtccgaggccaaggacggacgaggctagactattacgtgtacaaacgagtaagacgagtaaggacgttactcgtagttgggtcgttcgggacgggtacgggaccgaaggtccgtacggtaacccggtaccgtacgggtcaaccggacccgaacgggtccctccggtccccccgtaccgg

SEQ ID NO: 202138 - DNA, 589 bp, Homo sapiens
  misc_feature: GYAE6OF02HXJXU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatccacctgctcgtgcagatggactcgaccaaaagaatatgtacttagttacggtaaccaaacaagaacgaccgacggcccacggccccttgtagttagtgaataataataaagactacgtagagacggccctacgagagactcccgtgacgcgtattctcgtcggcctccgagctacgacgggacagcgtacgtcgtacgtttagactagtacgtagtagtaacgtccgaggacgaggacggacggacggtcgtagtacttattactcgtaacaaagtagtagacgaagtagagtactgtagttgggtgtcgggagggacggaccgaagtctacggtaccgttacgtacgtacgacgacccgaggccgtcccgcccgttccgg

SEQ ID NO: 202139 - DNA, 657 bp, Homo sapiens
  misc_feature: GYAE6OF02F3VAW.21.46.E02.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgacttattggtaccaacagaagccaggccaggcccctgtgttagtgaatatataaagacactagagacggccctnagagactccgtgagccgtattcctcgtgggcctaccgagtccgttaccgaggggaacacggacgtacgtccgtaacggttcgaacttacgtacgtaaggtacggtaacgtccgaaggacgtaagggacgggaacgtagggcttacggtacttacgttactacggtaaccaaacgttaggtaacgaacgtaggttaacggaggttacttacgtaacggtttgggtacgggttacgggaccgggtaagggacccgtaaggtccgtaccgggtaacccggttaccgttagggtacccgtacggaccccggtaaggtcccgtacccggtccccgttacccggg

SEQ ID NO: 202140 - DNA, 553 bp, Homo sapiens
  misc_feature: GYAE6OF02JJ848.21.46.E02.1.454.CMB.1.raw
tcagtcgtcgctcgcacgaccggtgctcgatttagactcatctacagggaaagggggtggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgtagtgatatataaagacactgagacggccctcagagactcccctagagcgtattctctaggctccagctcgagggacagcagtcacgttgactatcagtgaagtcaggcaggaggacgaggcgtagactattactgtaccaaagagtaacgacgaagtaggtagtacgtagtagttagggtggttacgggcgggaagggaccgaaggtacgtacggaccgtaccgtacggttacacggtacccgaacggtccgtacggtaccccctacggg

SEQ ID NO: 202141 - DNA, 568 bp, Homo sapiens
  misc_feature: GYAE6OF02HITL3.21.46.E02.1.454.CMB.1.raw
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgacttattggtaccaacagaagccaggccaggcccctgtgttagtgatatataaagacactgagaggccctnagagatccctgagcgattctctggctccagctcgaggacagcagtcacgttgactatcagtagaagtccaggcaggaggacgaggctaggacttagttactgtacaaacagttaagacgaagtaggaaggttaactcgtaagtttggggtggtttaccgggcgggaagggtaccgtaaggtccgtaggtaacccggtccgttaaggtccgacggtaccccgaaagggtccctaccggtccccccgttacccggg

SEQ ID NO: 202142 - DNA, 563 bp, Homo sapiens
  misc_feature: GYAE6OF02FWME8.21.46.E02.1.454.CMB.1.raw
  modified_base (385)..(385): a, c, t, g, unknown or other
  misc_feature (385)..(385): n is a, c, g, or t
  modified_base (462)..(462): a, c, t, g, unknown or other
  misc_feature (462)..(462): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggcttctggaggcctcctatgagctgacacagcccaccctcggtgtcagtgtccccagggacaggacggccagggatcacctgctctgcagatggactgaccaaaagaatagtgcttattggtacctaacagaagccaggccaggccccctgtcgttagtgatatataaagacactgagaggccctcagagatccctgagcgattctctggcctccgagctcgagggtacagcagtcacgttgactancgagtgaagtccaggcaggacggacgaggctaggactattactgtacaaactagtaagacaagtaggaggttactanaggtttcgggtcgttaccgggcgggagggaaccaaggccgttcgggacccgttaccgtagggtccacggaccccgtaaggtcctaccggccccgttacggg

SEQ ID NO: 202143 - DNA, 547 bp, Homo sapiens
  misc_feature: GYAE6OF02GSAOG.21.46.E02.1.454.CMB.1.raw
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
  modified_base (426)..(426): a, c, t, g, unknown or other
  misc_feature (426)..(426): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagacgccctanagagatccctgagcgtattctcgtggctccgagctcgagggacagcagtcacgttnactatcagtgaagtccgaggcaggacggacgagctagacttattactgtacaaanagtaacgacgtagtaagagttactntaggttgggtgtcgggacggtacgggacgtaaggtcgtacggacccgttacgtaggtaccgacggtcccgaacggccgtaccgtcccccgtaccgg

SEQ ID NO: 202144 - DNA, 686 bp, Homo sapiens
  misc_feature: GYAE6OF02GVRGT.21.46.E02.1.454.CMB.1.raw
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
tcagtcgtcgctcgcacgaccggtgctcgatttagactcatctacagggaaagggggtggggtccgaggaggcagaactctgggtgtctcaccatggcctggatccctctacttctccccctcctcactctctgcacagctctgaggcctcctatgagctgacacagcccacccgtggtgtcagtcgtccccaggacagacggccaggatcacctgcctctgcagtatggactgaccaaaagaaatntgcttatggtaaccaanagaagcaggccacgccctgtgttaggtnatataataaagacactagagtacggccctanagtagactaccccgtgaacgtcgaatttccngtacggcttacccaggtcctacgaacgggtacagtacgacggttacaacgtttcgaactaacgtctaggtagtaacgttccggaaggcgtaaggacggaacgagggtacctaggtaacgttaattacgttacgtacctaaaacgtacggtaaacgtaaccgtaaagttaacggaacgggttaactaccgttaaggtttaggggttacggtttacggggacggggtaacggtaacccggtaaacggtcgttaccggtaacccgggttaccgttaacgggtaccgtaaccggtaacccgaacgggtcccgttaccggtaccccccgttaccggg

SEQ ID NO: 202145 - DNA, 541 bp, Homo sapiens
  misc_feature: GYAE6OF02HQ1SB.21.46.E02.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatggactgaccaaagaaatatgcttattcggtaaccaacgagaacgccaggccaggcccctgtgttagtgatataataagacactgagcggccctcaganactccgtgagcgattctctcggctccagctcgagggacagcacgtctacgttgactatacgtagtagaacgtccgaggcaggaggacgaggctgacttatactagacaacgagtagacgagtagaggttactcgtagttgggttgtcgggacggacgggtaacacggcgtaggacccgtacgtaggtcgaccgaccgacggcctccgtccccgtcgg

SEQ ID NO: 202146 - DNA, 735 bp, Homo sapiens
  misc_feature: GYAE6OF02IYQ7Q.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcactgctctgcagatggactgaccaaaagaaatntgacttattggtaaccaacagaagccaggccacggcccctggtattagtgaatataataaagacacgtgagacggccctacgaagagactacccgtgacgacgtatttcctacgtcggcctacccgagtccgtcgaacggggcacgaccgtacgtaccgtacggtttagacttacgtacgtaggtaacgtaacggttaccgaaggaccgtaagggaaacgggaccggtaaacggggtcgttaacgtaaccgtttaagtttaaccgtacgtaaaccgtaaaaaccgtaagggttaaaccgaacggttaaaggtaacggttaacggttaaccttacggtacggttttacggggttacggttaccggggacgggtaaacgggtaccgaaacggggttcctacgggtaaaccccggttacgttaaccgggtaccggtaaccgggaaccccggtaaaccgggtcccggtttaccccggtccccccggtttaacccgg

SEQ ID NO: 202147 - DNA, 752 bp, Homo sapiens
  misc_feature: GYAE6OF02I3R65.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcctgcagatggactgaccaaaagaatntgcttattggtaaccaacagaagccaggccacggcccctgtgttagtgatatataagacactgagacggccctagagagactcccgtgacgcgtacttctacgtcggaccttccgaacgtcctacgaacggggaccaaggacctaacggtccgtaacggtttacggaaccttaagttaccgtaaagggttacggtaaacggttcccgaaacgggacgaaacgggaacgggtaacggaacgggtacctacgggtaacttaacgtttaacgtacgttaaaccgaaaacgtaacggtaaacgaacgtaaacggttaaggtaacggttaacctacgttacggtttaggggtttacggttaccgggggaccggggtaacgggaacccggtaaagggtaccccgtttaacgggtaacccccggtttacccggttaacggggttacccgaaccgggtaaccccggttaacccgggtacccggttaccccggtaccccccccggtttaacccggg

SEQ ID NO: 202148 - DNA, 517 bp, Homo sapiens
  misc_feature: GYAE6OF02GLY7H.21.46.E02.1.454.CMB.1.raw
  modified_base (312)..(312): a, c, t, g, unknown or other
  misc_feature (312)..(312): n is a, c, g, or t
  modified_base (376)..(376): a, c, t, g, unknown or other
  misc_feature (376)..(376): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctnagagatccctagagcgtattctctggctccagctcgaggacagcagtcacgttgactatcagtnaacgtccgaggcagacggacgaggcagtactattactgtacaaangtagacagtaggagtactcgagttggtgtcgggcggagggaccaaggtctggaccgtaccgtaggtcgacgcccgaagcgtaccgccccgtaccgg

SEQ ID NO: 202149 - DNA, 561 bp, Homo sapiens
  misc_feature: GYAE6OF02IWEZ7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgacttattggtaaccaaacagaagccaggccaggcccctgtgttagtgatatataaagacactgaagacggccctacagagatccctagagcgattctctggcctcagctacgaggacagcagtctacgttgactatcagtgaagtccaggacaggaggacgaggctcgaacttattactgtaacaacgtagtaacgagtagtagtacgttactagtagtttgggtacggttcgggacgggtacgggtaccaaggtccgtaggacccgttacgacgtacgaccgtcccgaacggtccgtacccggcccgttacccgg

SEQ ID NO: 202150 - DNA, 579 bp, Homo sapiens
  misc_feature: GYAE6OF02GPDO9.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacagaagccaggaccaggcccctgtgttagtgatataataagacatgagagccctnagagactccctagacgcgtattctcgttcggcctccgagcgtcgagggacagccagtcctacgttagactatcagtgactcgagcgaaggacggacgaggctagacttattacgtagtacaaactagtaagacgtaaggtaacggaaggttacctacgtaaggtttggggttacgttacgggacgggtaagggaaccgtaaggccgttacggacccgttaccggtacggtcgacgacccgacggtccgtccccgcccgttaccgg

SEQ ID NO: 202151 - DNA, 869 bp, Homo sapiens
  misc_feature: GYAE6OF02H8F3T.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggaggcctcctatgagctgacacagccaccctcggtgtcagtcgtccccaggacagaccggccaggatcacctgctctgcagatggactgacaaaagaatatgtcttagttcggtaaccaacgagaagaccgaggacccacggtacccctgttggtttaagtagtaattataaagttaaaaggacctaacgttggaacggaccggtaccccttacgaaggtaacgtacgttacccccgtagggaacgccggttaactttcccgttcggtcgggtaccttaccgaagtccgtacggaacggggtaaccaacggccgttaacgggtcctttaacccgggtttagtaacccgtttaataccggtaaacgggtttaggaaacccggttacccggaaacgggtcgaaagggtaaccggggtaaaccgggtacgggtaccgtttaacggaaaccgttttaaaccgtttaaccgttacggtaaaccgtaaaaccggttaagggttaaaccgtaacggtaaacgggttaaacgggtacgggtttaaacccgtttaaggtaacgggtttttacgggggtacgggttttaacccgggggaccggggtaacgggggttaaacccgaacggggttacccgttaccggggtaaccccggtttcccggtaagggtttccggaacccggtaaccccggttaaacggggccccgtttacccccggtcccccggtttacccggg

SEQ ID NO: 202152 - DNA, 578 bp, Homo sapiens
  misc_feature: GYAE6OF02HX7EH.21.46.E02.1.454.CMB.1.raw
  modified_base (326)..(326): a, c, t, g, unknown or other
  misc_feature (326)..(326): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatggactgaccaaaagaatatgtacttattgtaccaaacagaagccaggccaggcccctgtgttagtgatataataaagacacttgagacggccctacaganactcccgtgacgtctacttctcgtcggctcctagctacgacgggtacagcgtagtcgtacgttagactatctaagttagaacgtcaggcagacggacgaggtcgtacgtacttagttactgtaacctaaacgtagtagaactagtacgaggttactcgattgggttagttcggacgggacggaacgtaaggtacgtacgtaccgttaccgtaggtcgacggtcccgaaggtcctccggtacccccgtacggg

SEQ ID NO: 202153 - DNA, 654 bp, Homo sapiens
  misc_feature: GYAE6OF02IY2BW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgcttattggtaaccaacagaacgccaggccacggcccctgtcgttagtgaatataataaagacactggagacggccctagagagactcccgtgacgcgtattctcgttaggccttaccagtcctacgaaggggtacagccgtaggttccaacggtttcgactaacgtcgaaggtacgtaacgttcccgaagggaccgtaaggaacgggaaccgggaggtacgttacggaacttaagtttaaccgttacggtaaccaaaacgtaaggtaacgtaacgtaaggtaacgggtaaggttaaccgttagtaggtttggggttcgtttacgggcgggaacggtacgaacggtccgtacggtacccgttacgtaccggttacgacggacccgaaggtccgtaccgcccccggttacgg

SEQ ID NO: 202154 - DNA, 563 bp, Homo sapiens
  misc_feature: GYAE6OF02F66PX.21.46.E02.1.454.CMB.1.raw
  modified_base (408)..(408): a, c, t, g, unknown or other
  misc_feature (408)..(408): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaaggcccctgtgttagtgatatataaagacactgagaggccctcagagatccctgagcgattcactggctccagctcaagggcagcagtcagttcactatcagtgaagtccaggacagagacgaggctgactattacngtacaaacagtaagactagtaagaggtactcgtaagtttcggggtagttcgggacgggtaacgggaaccgtaacggccgtaaggtaaccccgttccggttaacgggtccgtaacggtaccccgaagggtcccttaccggtccccccgttaccggg

SEQ ID NO: 202155 - DNA, 509 bp, Homo sapiens
  misc_feature: GYAE6OF02F1RLL.21.46.E02.1.454.CMB.1.raw
  modified_base (367)..(367): a, c, t, g, unknown or other
  misc_feature (367)..(367): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaagacactgagagccctgagagatccctgagcgattctctggctccagctcgacgggacagcagtcacgttnactatcagtgagtcagcagaggacgaggctgacttatacgtgtacaacagtaagacagtagagtaacntaagttgggtgtcggnggaggacaaggctgaccgtcgtaggtaccacggacccgaggtccctcgccccgtacgg

SEQ ID NO: 202156 - DNA, 512 bp, Homo sapiens
  misc_feature: GYAE6OF02GHDUZ.21.46.E02.1.454.CMB.1.raw
  modified_base (318)..(318): a, c, t, g, unknown or other
  misc_feature (318)..(318): n is a, c, g, or t
  modified_base (446)..(446): a, c, t, g, unknown or other
  misc_feature (446)..(446): n is a, c, g, or t
  modified_base (461)..(461): a, c, t, g, unknown or other
  misc_feature (461)..(461): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgactttattggtaccaaacagaagccaggccaggccccctgtgttagtgatatataaagacactgagaggccctnagagatccctgagcgtattctctggcctccagctcgagggacagcagtcacgttgactatcagtgagtccaggcaggaggacgaggctagactaattctagtacaaacagtagacagtagagttactnagttgggtgttcggnggaggaccgaagctgaccgtcgtaggcagcccgaaggcctcgcccctacgg

SEQ ID NO: 202157 - DNA, 594 bp, Homo sapiens
  misc_feature: GYAE6OF02GPPKX.21.46.E02.1.454.CMB.1.raw
  modified_base (246)..(246): a, c, t, g, unknown or other
  misc_feature (246)..(246): n is a, c, g, or t
  modified_base (265)..(265): a, c, t, g, unknown or other
  misc_feature (265)..(265): n is a, c, g, or t
  modified_base (428)..(428): a, c, t, g, unknown or other
  misc_feature (428)..(428): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctctatgagctgacacagcccacccgtcggtgtcagtcgtccccaggacagacggccaggatcacctgctctgcagatggactgaccaaaagtaaatntgacttattggtaaccaanagaagccaggccaggccctgtgttagtgtatataataaagacactgagacggccctagacgagtactaccgtgacgtcgtacttctcgtaggcctccgacgctcgaggacagtcagtactacgttgactatcgtagtgtaacgtcaagggcgaggacggacgnggactgacttattagtcgtaacaaactaggaagacgtaaggtaagtaacgtacttacgtaggtttaggggtcgttaccgggacgggtaacgggtaccgaacggtccgacggtacccggttacgttacgcgaccggaccgtaaccggcgtacccggccccgttacgg

SEQ ID NO: 202158 - DNA, 528 bp, Homo sapiens
  misc_feature: GYAE6OF02I95HD.21.46.E02.1.454.CMB.1.raw
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (442)..(442): a, c, t, g, unknown or other
  misc_feature (442)..(442): n is a, c, g, or t
  modified_base (461)..(461): a, c, t, g, unknown or other
  misc_feature (461)..(461): n is a, c, g, or t
  modified_base (486)..(486): a, c, t, g, unknown or other
  misc_feature (486)..(486): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaatatgcttatggtaccaanagaagccaggccagccctgtgtagtnagtatataaagacacgtgagacggtaccctgagagactaccctgaacgcgattcgtctggcttccgagctcgacgggacacgtcagtccagttcgactacgtcagtacgaacgtccaaggtcaaggtaggacgaggctgaacttagtctagtacaaanagtagacagtagagtactntagtggtgtcgaggaggtacagtancggacgtcgtaaggtcacggacacgaacggctacggtccccg

SEQ ID NO: 202159 - DNA, 644 bp, Homo sapiens
  misc_feature: GYAE6OF02JOCCI.21.46.E02.1.454.CMB.1.raw
  modified_base (248)..(248): a, c, t, g, unknown or other
  misc_feature (248)..(248): n is a, c, g, or t
  modified_base (505)..(505): a, c, t, g, unknown or other
  misc_feature (505)..(505): n is a, c, g, or t
tcagtcgtcgctcgcacgaccggtgctcgatttagactcatctacagggaaagggggtgggtccgaggaggcagaactctgggtgtctcaccatggcctggatcctctacttctcccctcctcactctctgcacaggctctgaggcctcctatgagctgacacacgccaccctcggtgtcagtcgtccccaggacagaccggccaggactcaccgtgcctctgcagatcgggactgaccaaagaaatntagcttataggtaccaacgagaacgccaggccacggcccctgtgttagtgactatataaaagcactgaaggacgtcccagaagacgactccgaggagcgttaattcgtctaggcctacgagccgttaacggacggggaactgaccgtagtaccgaggttacggtactacgtacgtacgtaaggtacgtacccgaggacgtaacggacgggaacggtagggccttaaggacttagtaactcgaacgtaaacgaggtanaaccggtgttaaacgtacgggttaaccacggttagtttcgggttaggtccgggtagggaacgggtaccggaacgtacggtacggacccttaccggtacgtacgtaccggaccgaacgggttcctcccggaccccgtcgg

SEQ ID NO: 202160 - DNA, 540 bp, Homo sapiens
  misc_feature: GYAE6OF02GNV6Y.21.46.E02.1.454.CMB.1.raw
  modified_base (242)..(242): a, c, t, g, unknown or other
  misc_feature (242)..(242): n is a, c, g, or t
  modified_base (290)..(290): a, c, t, g, unknown or other
  misc_feature (290)..(290): n is a, c, g, or t
  modified_base (318)..(318): a, c, t, g, unknown or other
  misc_feature (318)..(318): n is a, c, g, or t
  modified_base (412)..(412): a, c, t, g, unknown or other
  misc_feature (412)..(412): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgcttagttggtaccaacgagaagccaggccaggcccctgtcgttagngtatatataaagacactgagacgccctnagagactcccgtgacgcgtattcgtcgtaggcctccgagctacgagggacagcgagtcagttgactatcagtgacgtccgaggcaggaggacgngctagacttatacgtagtacaaagagacgacagtagagtactagagttgggtagttcggacggacggacaaggctacggaccgttacgtaggtcacggtacccgaaggtccttaccggaccccttcgg

SEQ ID NO: 202161 - DNA, 543 bp, Homo sapiens
  misc_feature: GYAE6OF02HSDSF.21.46.E02.1.454.CMB.1.raw
  modified_base (315)..(315): a, c, t, g, unknown or other
  misc_feature (315)..(315): n is a, c, g, or t
  modified_base (429)..(429): a, c, t, g, unknown or other
  misc_feature (429)..(429): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagacggccctnagagactccctgagcgtattctctggctccagctcgagggacagcagtcacgttgactatcagtgaacgtcaggtcaggacggacggaggctgaacttagttactgtacaaagngtaagacagtagacgtactacgagttagggtgttcggacgggtaggaaccgaaggccgtacggacccgttaccgtaggtacgacggcccgaaggcctccggcccccgttaccgg

SEQ ID NO: 202162 - DNA, 628 bp, Homo sapiens
  misc_feature: GYAE6OF02I98SC.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatatgcttattggtaccaacagaagcaggccaggcccctgtcgttagtcgatatataaagacactgaagtacggccctgaacgagactcccgtagaacgcgtaactttctcgtaggccttaccaggtctccgaaggggaccaggcctaacgtctaacgttgaacttagtcagttcggaaacgtccgaggtacgaaggacggacggtaggcgttaagacgttaacttacgtagtaaccaaagtaggtaaacgaacgtaagtaggaaggttaacttacgtagttaggggtacgttcgggtacggaacggggtaaccaaacggtccgtacgggtaacccgtccggtaaggttccgaacgacccggtaaggcccgttaccggcccccgttaccgg

SEQ ID NO: 202163 - DNA, 555 bp, Homo sapiens
  misc_feature: GYAE6OF02GKCDC.21.46.E02.1.454.CMB.1.raw
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgcttagttggtaaccaacgagaagccaggccacggcccctgtgttagtgatataataaagacactgagacggccctacagagactccctgagcgtatttcgtttggcctccgagtcgtacgagggacagcagtctacgttgactatcagtagaagtcgaggcaggaggacgaggctagacttattactgacaanagtagacagtagaggtactcgagttggtgttacgggacggagggaccaaggtccgtacggacccgttcgtacggtaccgacggacccgaagggtcctacccggcccccgtggtaccc

SEQ ID NO: 202164 - DNA, 548 bp, Homo sapiens
  misc_feature: GYAE6OF02GP2CT.21.46.E02.1.454.CMB.1.raw
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (418)..(418): a, c, t, g, unknown or other
  misc_feature (418)..(418): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccctagagcgattctctggctcagctcagggacagcagtcacggttnactatcagtgaagtcaggcagaagcgaaggcgtagactatactgtacaaacngtagacagtaagagtactctaagttgggtagttcgggcggtagggaacccgtaaggtaccgtaggtacccggtaccgttaagggtccgtacggaccccgtaaggtccgtaccggtccccccgttaccggg

SEQ ID NO: 202165 - DNA, 604 bp, Homo sapiens
  misc_feature: GYAE6OF02IVFZA.21.46.E02.1.454.CMB.1.raw
  modified_base (332)..(332): a, c, t, g, unknown or other
  misc_feature (332)..(332): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgtcttagttcggtaaccaacaagaacgccaggccacggcccctgtgttagtgtataataagtaaagacacgtagagcggacctcgaganactcccgtagacgcgtattctcgtcggtcctccgacgtctacgaacgggacacgccagtacctacgttgactatacgtagtagtaacgtcgaaggtacgaaggacggacggaggtcgtagtacgttagttacgtcgtaaacctaaagaagtaacagaagtaaggacgttaactagtagttaggggtcgttacgggacgggacggtaccgaaggtccgtacggtccgtaccgtaaggccgtacggaccgacggtccgtccgtccccgtaccgg

SEQ ID NO: 202166 - DNA, 866 bp, Homo sapiens
  misc_feature: GYAE6OF02IWERZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaacggccgacgagtactacctacgtcgtctcggtagacttacgaattgggacctaaaaggaacctaaaagtaaacttagttacggtaccttaagtacgtaaacgaaacgtacgaaaggccccaagggtccccctaaggtccccgttaggttaccgttaacgttacgaattaaggtaacggtaaaccgaacgtaccgtaacggaacgaccggtcccggactacccgtaggactaccgtagtacgtctacttcctcgtacggccttaccgaagggacctaggtacgggaaccctacggttcgtaaacgtacttacgttacgggtaccgggtacctaagggtacgggtaacgtaaccgtacggaaacgggtaccgtaaggtaaccggttaacgttaacggtttaccgtttaaaccggaaccgttaaccgttaacggtaaccgtaaacggttaaacggttaacggtaaccgtaacgttaaccgggttaaaggggtaccgtttacgggaacgggttaacggggttacggttaacgggtttacgggaccggttaaccgggttaccgggtaacgtaacccggttaacccgggtaaaccggttacccggttaccggtaaccccggttccggtaaacccgtaacccggttcccgttcccgggttacccccctaacccggg

SEQ ID NO: 202167 - DNA, 501 bp, Homo sapiens
  misc_feature: GYAE6OF02IY2K5.21.46.E02.1.454.CMB.1.raw
  modified_base (313)..(313): a, c, t, g, unknown or other
  misc_feature (313)..(313): n is a, c, g, or t
  modified_base (436)..(436): a, c, t, g, unknown or other
  misc_feature (436)..(436): n is a, c, g, or t
  modified_base (480)..(480): a, c, t, g, unknown or other
  misc_feature (480)..(480): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggcccctgtgttagtgatatataaagacactgagaggccctnagagactccctgagcgattctctggctcagctcgagggacagcagtcacgttgactatcagtgaagtccaggcagaggacgaggctgactattactgtacaaacagtagacagtagagtactnagttggtgttcggcggaggaccgaagctgaaccgtcgtaggtcngacccgaggctcgcccctcgg

SEQ ID NO: 202168 - DNA, 745 bp, Homo sapiens
  misc_feature: GYAE6OF02J25YB.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacacgacggccagggactccacctgctctgcagatggactgaccaaaagaatatcgtacttattacggtaaccaacagaacgcacggccacggtcccctgtgttatgataataataaagacacgtgacgacggaccctcgaagacgtactcccgtagacgtacgtactctcgtcggtcctaccacgtaccgtacggaacgggaaccgtaagacctacggttaccgttacgtttacgggtaacctaacgtaccggttaaggtaacgggtaaccggtaccggtaacggggtaccgaaaggggttaacgggaaccggtacggggactttaacggaacctttaaacgttcgttaacggtaaaccaaaacgtaacggttaacgacggtaaagttaacggtacggttaacttacggtacggttgggttaccgggtacgggtacgggaaccgggtaaccgtaacgggtacccgacgggtaacccgttacggtaacggttcccgaaccgggtaacccgtaaccggtcccggttccccgttacccccggtttaacccgg

SEQ ID NO: 202169 - DNA, 550 bp, Homo sapiens
  misc_feature: GYAE6OF02FNBU8.21.46.E02.1.454.CMB.1.raw
  modified_base (315)..(315): a, c, t, g, unknown or other
  misc_feature (315)..(315): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (408)..(408): a, c, t, g, unknown or other
  misc_feature (408)..(408): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgcctctgcagatggactgccaaagaaatatgcttattggtaccaacagaagccaggccaggccccctgtgttagtgatatataaagacactgagaggcccctnagagatccctgagcgattctctggcctccagctcgagggacagcagtcacgttgactancagtgaagtcaggcagagacgagcngatatactntacaaacagtagacagtaagaggtactacgagttgggttggttcgggacgggtaggggaaccgtaaacggccgttacggaacccggttccgtaagggtaccgacggaccccgaagggtcctacggtcccccccgttaccggg

SEQ ID NO: 202170 - DNA, 533 bp, Homo sapiens
  misc_feature: GYAE6OF02HSRIO.21.46.E02.1.454.CMB.1.raw
  modified_base (433)..(433): a, c, t, g, unknown or other
  misc_feature (433)..(433): n is a, c, g, or t
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctcgcagatggactgaccaaagaaatatgcttattggtaccaaacagaagccagccaggcccctgtgttagtgatatataaagacactgagacggccctagagagactccctgagcgattctcgtggctccagctcgagggacagcagtcgacgttgactatcagtgaacgtcaggcagaggtacgaggctagacttagttactagtacaaagagtanacgagtaagagttactntagttgggttacgtcgggcggaaggtaccaaggctaggaccgtaccgtaggtcacggacccaaggtcctccggccccttacgg

SEQ ID NO: 202171 - DNA, 530 bp, Homo sapiens
  misc_feature: GYAE6OF02FXH5V.21.46.E02.1.454.CMB.1.raw
  modified_base (313)..(313): a, c, t, g, unknown or other
  misc_feature (313)..(313): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcccggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagaggccctnagagactccctgagcgattctcgtggctccagctcgagggacatcagtcacgttgactatcagtgaagtccaggcaggacggacgaggctgacttattactgtacaaanagtagacagtagacggtactagagttgggtgttcggacggagggaccaaggcctaggacccgtccgtaggtccacggacccgaaggcctccggacccccgtggtaccc

SEQ ID NO: 202172 - DNA, 620 bp, Homo sapiens
  misc_feature: GYAE6OF02H6PE6.21.46.E02.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagactcatctacagggaaaggggtgggtccaggaggcagaactctgggtgtctcaccatggcctggatccctctacttctcccctctcactctctgcacaggctctgaggcctcctatgagctgacacagccaccctcggtgtcagtcgtccccaggacagacggccaggatcacctgctctgcagntggactgaccaaaagaatgtgtacttattggtaccaacagaacgccgaggccgacggcccctgtcgttagtgatataataaagacactgagacggcctacgagagtactccgtgacgcgtattcgtctcggctacagctacgacggtacagcgtacgtcacgttcgactatcgtagtagtaacgtccgaggtcaaggaggaacgacggtcgtagaacttagttactagtaacctaaacgtaggtaacgacgtaagtacggtaacgttaacgtacgtaggtttcggggttacggttacgggacgggtaacgggaaccgtaacggccgttacggacccgttaccggttacggtacgaaccgggtacccgaacgggtcccttacccggtcccccgttaccggg

SEQ ID NO: 202173 - DNA, 548 bp, Homo sapiens
  misc_feature: GYAE6OF02HYB4L.21.46.E02.1.454.CMB.1.raw
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
  modified_base (482)..(482): a, c, t, g, unknown or other
  misc_feature (482)..(482): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgcttattaggtaccaacagaagccaggccaggcccctgtgttagtgatataagtaaagacactgagacggccctgagagactcccgtgagctattctcgtggctccgagctacgagggacacgacacgtcgacgttagacttatacgtagtacgaacgtcgaggacgaggaggacgngactagactattacgngtaacaagagtaagagagtagaagtctacgtagttgggtagtcggnggaacggacaagtcgtaggaccgttacgaggtccacggaccgaaggtcctcccggtaccccgtcgg

SEQ ID NO: 202174 - DNA, 538 bp, Homo sapiens
  misc_feature: GYAE6OF02GO441.21.46.E02.1.454.CMB.1.raw
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctnagagactccctgagcgattctctggctccagctcgagggacagcagtcacgttgactatcagtgaagtccgagcagaggacgagctgacttattacgtgtacaactagtagacgagtagagtactacgtagttgggtagttcgggcgggacgggtaccgaaggacgtacggacccgttaccgttagggtaccacggtacccgaaggcctccggcccccgttaccgg

SEQ ID NO: 202175 - DNA, 541 bp, Homo sapiens
  misc_feature: GYAE6OF02GKQW4.21.46.E02.1.454.CMB.1.raw
  modified_base (403)..(403): a, c, t, g, unknown or other
  misc_feature (403)..(403): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctcctatgagctgacacagccacccttcggtgtcagtgtccccaggacaggaccgccaggatcacctgctctgcagatggactgaccaaagtaactatgcttatggtaccaacgagaacgccaggccgaggcccctgtgttagtgatatataaagcacgtagagacgccctgagagactccgagacgcgtatttcgctacggtcctcagtctcgagggactagcgtagtccacgttgactatcgagtgaacgtccgnggacaggaggacgagtactcgattactactagtaccaagngaagacgagtacgagtacngtagttggacgttggacggaggtacaaggtcgtacgaccgtcgtacgtcgacgacccgtaggccgtacccgcccgtcgg

SEQ ID NO: 202176 - DNA, 642 bp, Homo sapiens
  misc_feature: GYAE6OF02HHPTE.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccgaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatngacttattacggtacaacagaacgcagccaggcccctgtgttagtgatatataaagacactgagtaggccctacgagagactccctgaacgcgtattctcgtggcctcccgaaggccttacggacgggaaacacggacctacggtactaacgttaggtactaagtaccgaaggttacgaacggttaccaacggggccaaggaacgggtacggaacgggttcgtacgtaaccgttaacgtttacgtaggtaccaaaacgaggttaaacgaccgtaagtaagtacggtttacacgttagtgggtttacgtcgggtacgggacgggaacctaaggcctacgtccggttaccgttaaggacgtccggacccgaacggtcgttaccccgaccccgttaccgg

SEQ ID NO: 202177 - DNA, 580 bp, Homo sapiens
  misc_feature: GYAE6OF02HGBHB.21.46.E02.1.454.CMB.1.raw
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccacggcccctgtgttagngatatataaagacatgagaggccctnagagatcccgtagacgcgattctctggctccgagctcgacgggacacgcgacgtactacgttgactatcgtagtagaacgtccaggtcaaggaggacgaggctagtactagttactgaacaaacgtagtaagacgtaagtacgaaggttactacgtaggttaggtgggttacgggacgggtaacggaccgtaaaggccgttacggaccccgttacggtaacggtcggacggacccgtaacgggcccgttcccgccccggttacccgg

SEQ ID NO: 202178 - DNA, 814 bp, Homo sapiens
  misc_feature: GYAE6OF02JBP93.21.46.E02.1.454.CMB.1.raw
  modified_base (753)..(753): a, c, t, g, unknown or other
  misc_feature (753)..(753): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtgtcccaggacagacggccaggatcacctgcttcgtcgacgagacgtacggacgtacgacaaacgtaacgtaacgtacgtacgttaacgttaacggtaaccgtaaacgaaacggaaacgccaaacgggacccgtaacgggtaccccgttacggttacggtttaacggttacggtaacgttaagttaacgtaaaacggtaacgtaaacgtacggaacggtaacgggtacccgtacgaacggtaacggtaacgtacccgtacggtaacggtaccggtaacgttacgtacgttacggtaccgttaccgtaacggtaccgtacgtaacgggtaacgaacggtacgtaacggtacgtaacggttacggtaacgtaacgtacgtaacggtacggtaaacggtaccgtaacgggtacgaacggaacgggtaacggtaacggtacgtacggtaacgttaacgttaacgtaacgtaacgtaaacgtaacgtaacgtaaacgtaacggtaacgtaacgtaacgtaacgtaacggttacgggttacgggttacgggtacgggtaacgggtaacggtaacggtnaaccggtacggtaacggtaccgtaacggtaccggtaacggtaccgtacggtacccgtacgg

SEQ ID NO: 202179 - DNA, 683 bp, Homo sapiens
  misc_feature: GYAE6OF02H4HFF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagaccggccaggactcgacctgctctgcagatggactcgacaaagaatatgtcttagttcggtaccaacagacgccacggccacggccctgttgtagtgatataataaagacactgagacgcctagagagtactccctggacgacgtacttcctcgttcggcctccgacgctacgagggtacacgtcgacgtactacggttacgtaaccttatcgtaacggtacggtaacgtaccgagggaacgaaggaacgggtacggaacgggccttacggtaacgtttaacgttagtaccgtaacgaaaacgtaaggtaacgtaaacgtaggttaacggaaggttaacccgttagtagggttttacggggttaccgggttacggggaccggggtaacgggtaacccgtaaggtaccggtacggttaaccgggtccgttacgggtaccgaaccgggtacccggtaacggcccgttacccggtccccccggttaccgg

SEQ ID NO: 202180 - DNA, 632 bp, Homo sapiens
  misc_feature: GYAE6OF02JJ4CU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaggaaactagtcgcttattcggtaccaaacgagaaacgccaaggcccgacggtccccctgtcgttagtgatataataaagacacgtgagacggccctacgagacgatccctgacgcgtattctctcggctccgagtcgtacgagggacagctacgtactacgttgaacttatacgtagtacgacggtaccgacggtcaacggacgggaacgacggctaggtaacttagttacgtacgtacgaaacgaggtaacgacgtaaggtagtaacggttactacggttaggttcgggtacggtttaccgggaggtacgggaccgtaaggtccgtacgggtacccggttacgtagggtaccgtacggaccccggaacggtaccgttacccgtacccccgttacgg

SEQ ID NO: 202181 - DNA, 524 bp, Homo sapiens
  misc_feature: GYAE6OF02GBVT9.21.46.E02.1.454.CMB.1.raw
  modified_base (315)..(315): a, c, t, g, unknown or other
  misc_feature (315)..(315): n is a, c, g, or t
  modified_base (397)..(397): a, c, t, g, unknown or other
  misc_feature (397)..(397): n is a, c, g, or t
  modified_base (417)..(417): a, c, t, g, unknown or other
  misc_feature (417)..(417): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggccccctgtgttagtgatatataaagacactgagaggccctnagagatccctgagcgattctctggctcagctcgagggacagcagtcacgttgactatcagtgaagtccgaggcagaggacgnggctgactatactgtacaanagtagacagtagaggttactacgtagttgggtgttcgggcgggagggaccgaagcgtggacccgttcgtaggtacacggtacccgaaggtcctccggcccccgtcgg

SEQ ID NO: 202182 - DNA, 588 bp, Homo sapiens
  misc_feature: GYAE6OF02GAPY7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctgcagatggactgaccaaaagaaatatgactttattggtaaccaacagaacgccaggccacggcccctgtcgttagtgatataataaagacactgagaggccctagagagactcctgacgcgtattctcgtggcctccagctcgacgggacagcagtctacgttagacttatcgagtgaacgtcgaaggcaaggacggacggaggtctagtaacttagttaactgtaacaaacgtaggtaagtacgtaagtacggtaacgttactagttagttcggggttagttccgggacgggacggaaccgtagccgtacggtacccgtacgtaggtaccgacgacccgtaacgggccttacccggccccgtaccgg

SEQ ID NO: 202183 - DNA, 776 bp, Homo sapiens
  misc_feature: GYAE6OF02ID1DT.21.46.E02.1.454.CMB.1.raw
  modified_base (160)..(160): a, c, t, g, unknown or other
  misc_feature (160)..(160): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagcngacacacgcccacccgtcggtgtcagtcgtccccaggacacggaccggccgaaggactccaccgtcgcctcgtacgacgagtagtagggtaacctacggaaaccaaaaagtaaattacgtacggttacttttaaggttaaccggtaaaccaaaacgaaggaaccgaccggaccggacccgacgggtcccccgttggtttaacggttaaggtaggtaattaaagttaaagtaaaacgtaacacgtaggaacggaccggtaccccttagaacggtaacgtaaccgttcccgtaggaaccgtcgttaactttcccgttcggtaccgggtaccttccgacggtccgtaaccgggacggaacgacgaccgtacggtaccgttacggttacgtaacttacggtacgtaggtaacgggtaaaccgtccggaacgggaacgaacgggacgggacggacggtacgtacgtaacgtttactacgtagtaaacaacggtagtaaccgagtaggtaacgttagttactcggttagtcgggttacggtagggacgtaacggacgtaaggcgtacggtacgtaccgtcggtaccgacggtaccgtacggaccgtccccgtccgtacccgg

SEQ ID NO: 202184 - DNA, 544 bp, Homo sapiens
  misc_feature: GYAE6OF02FYCHN.21.46.E02.1.454.CMB.1.raw
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
  modified_base (317)..(317): a, c, t, g, unknown or other
  misc_feature (317)..(317): n is a, c, g, or t
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggccaggatcacctgctctgcagatggactgaccaaaagaaatatgcttattggtaccaanagaagccaggccaggcccctgtgttagngatatataaagacactgagaggccctnagacgatccccgtgagcgtattctcgtggcctccagctcgagggacagcagtcacgttgactatcagtgaagtccaggcaaggagacggagcagactattacngtacaaacgagtaagacgagtagacgttactcgtagttgggtagttcgggacggagggaccgaaggaccgtcggaacccgtcgtaggtcgacggacccgaaggtccctaccgtcccccgtacgg

SEQ ID NO: 202185 - DNA, 264 bp, Homo sapiens
  misc_feature: GYAE6OF02IK5DA.21.46.E02.1.454.CMB.1.raw
  modified_base (246)..(264): a, c, t, g, unknown or other
  misc_feature (246)..(264): n is a, c, g, or t
tcagtcgtcgctcgcacgaccggtgctcgatttagactcatctacaggggaaagggactggagtggttattattcctggggccagggaaccctggtaaccgtctcctcagcctccaccaagggcccatcggtcttccccctggcgccctgctccaggagcaccttccgagagcacagcggccctgggctgcctggtcaaggactacttcccgagcgacgactgagcgggctggcaaggcgcatagnnnnnnnnnnnnnnnnnnn

SEQ ID NO: 202186 - DNA, 611 bp, Homo sapiens
  misc_feature: GYAE6OF02GRDF6.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaaggggtaggggtccgaggaggcgagaactctggtggtctcaccatggcctggatcctctacttctcccctcctcactctctgcacagctctgaggcctcctatgagctgacacagccacctcggtgtcagtgtccccaggacagacggccaggatcacctgctctgcagatggactgaccaaagaaaatngtattatgtaacaagagaagcagctagcctgtgtagtatataatataaagactactagagacggtcctacgagacgacttaccgtagacgacgtaacttctcgtggacctcagtcctacgaacggaacgacgacgtacgtccaacgggttacgtaacgtaactacgtagtaacggtaagtaccgtacggacgaaggaacggaacggagacgtagtacgtaacttacgtagtaacaaacgtagaagtaacgtaagagtaacgttaacgtacgtagttagggttcggtacggtaggtaacgggacgaaacggacgtaccggtaaccgttccgtaaggtacgaccgaccgaacgccggtaccgtaccccgtcg

SEQ ID NO: 202187 - DNA, 580 bp, Homo sapiens
  misc_feature: GYAE6OF02IZB2E.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacctcggtgtcagtgtccccaggacagacggccaggatcacctgctctgcagatggactgaccaaagaaatatgcttattggtaccaacagaagcaggccacggcccctgtgttagtgatatataaagacactgagacggcctcgagagactcccgtgacgcgtattctcgtcggctccagcctacgacgggacagcagtctacgttgacttatcagtgaacgtcgaggacgagaaggacgaggctacgacttattacgtacgtacaaacgtagtaacgagtaagtagtacgttacgtacgtaaggtttgggtacgttacgggacgggtaacgggaaccgtaaggtaccgtaggtacccgttacgtacggtacctacggacccgaagggcccttccggaccccccgttccgg

SEQ ID NO: 202188 - DNA, 507 bp, Homo sapiens
  misc_feature: GYAE6OF02F0BOR.21.46.E02.1.454.CMB.1.raw
  modified_base (315)..(315): a, c, t, g, unknown or other
  misc_feature (315)..(315): n is a, c, g, or t
  modified_base (454)..(454): a, c, t, g, unknown or other
  misc_feature (454)..(454): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgttagtgatatataaaagacactgagaggccctnagagatcccctgagcgattctctggctccagctcagggacagcagtcacgttgactatcagtgaagtccaggcagaggacgaggctgactattactgtacaaacagtagacagtagaggtactcagttgggtgttcggnggagggaccaaggctgaccgtccgtaggtcacgacccgaggctcgcccctcgg

SEQ ID NO: 202189 - DNA, 820 bp, Homo sapiens
  misc_feature: GYAE6OF02IRJD8.21.46.E02.1.454.CMB.1.raw
  modified_base (142)..(142): a, c, t, g, unknown or other
  misc_feature (142)..(142): n is a, c, g, or t
  modified_base (252)..(252): a, c, t, g, unknown or other
  misc_feature (252)..(252): n is a, c, g, or t
tcagtcgtcgctcgcacgaccggtgctcgatttagactcatctacaggggaaagggggtggtccaggaggcaggaactctgggtgtctcaccagtgggcctggatccctctacttcctccccctcgtcactctctgccacgnggctcgtcgacgtcccttcctagtgacgctggacacacgcccaccttcggtgcagttcgcccgaggacacggtacggccagggactccaccgttgctacgtgacgagtancggactcgaccaaaagaatgtgtacttagttcggaaccaagtagagccgtacggcctacgggccccttaggtagttacggacgtaacttaagtaacgaaaacggacctaaccgttaggaaccgtaccggacccctttaaggtaacgaacggttaactccccggttaaggacgtccggtaaacttttccggtacggttccgggaccttaccgtagacccgtttacgggacggggtaacccaggtccgtaacggtttaccgtacggttacggtaacctttacgtaccggtaacggtaccggtaacgttaacccgtacggtaccgtaaacggtaccgggtaacggacggtacggtaacgtaacgtttacgtaacgttacgaaacctaaacgttacggaaccgtaacgtaacgttaaacggtacgtttaacccgtacgttaaggttacgggttacggttacggggaccggtaacgggtaaccggtaacggccggttaacgggacccggttaccgtaaggtcccgtaaccggtacccggtaacggtcccggtaccggtacccccggttacggg

SEQ ID NO: 202190 - DNA, 666 bp, Homo sapiens
  misc_feature: GYAE6OF02I56A0.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatccacctgctctgcagatggactgaccaaagaatntgtcttattacggtaaccaacgagaacgccaggccaacggcccctagtgttacgtgtaactaagtaataaacgacgacgtaggaaggacgccctacgagacgactcccgtagacgcgtacttctacgtcggcctaccagtctacgaggacacgcagtctacgttagactactcgagttacgaacgtccgaggacaaggaacggacggaggtacgtacgtaacttaacgttacgtaccggtaacaaacgtacgttaaggaaccgtacgggttaagtacggttacgttacgtacggttttacgggtaggttaccggggacggtaacgggtaaccgtaacggtaccggttaaccggtaccggttaccgttaacgggtaccgaccgggtacccgtaccgggtccgtcccggtaccccgttacccggg

SEQ ID NO: 202191 - DNA, 526 bp, Homo sapiens
  misc_feature: GYAE6OF02HZ2SH.21.46.E02.1.454.CMB.1.raw
  modified_base (437)..(437): a, c, t, g, unknown or other
  misc_feature (437)..(437): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgcttattggtaccaacagaagccaggccaggcccctgtgttagtgatataataaagacactgagacggccctacagagactacccctggagtcgatttcctcgtcggctccagtctacgagggacagcagtcacgttgactatctagtagaagtccaggacaggaggacgaggctagacttattactgtacaanagtagacagtagagtactgagttgggtgtcggcggagggaccaaggctgaccgtcgtacggtcgacggaccgaggctccgccccgtcgg

SEQ ID NO: 202192 - DNA, 552 bp, Homo sapiens
  misc_feature: GYAE6OF02H615N.21.46.E02.1.454.CMB.1.raw
  modified_base (259)..(259): a, c, t, g, unknown or other
  misc_feature (259)..(259): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagccgacacagccaccctcggtgtcagtgtccccaggacagacggccaggatcacctgctctgcagatggactgaccaaagaaatatgcttattggtaaccaanagaagccaggcacggcccctgtgttagtgatatataaagacactgagacggccctcagagactccctagagcgattcctcgtggctccagcctcgaacggacagctagtccgacgtttgactatcacgtgaagtcgaggcagaggcgagctgactattacgtgtacaaacgtagtacgactagagtaacggtactacgtagttgggttgttcgggacggtagggacccgaggtcgtacggaccgttcgtaacggtcacggcccgaaggtccctccggtcccccgtcggtaccc

SEQ ID NO: 202193 - DNA, 611 bp, Homo sapiens
  misc_feature: GYAE6OF02GY5X9.21.46.E02.1.454.CMB.1.raw
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
  modified_base (467)..(467): a, c, t, g, unknown or other
  misc_feature (467)..(467): n is a, c, g, or t
tcagtcgtcgctcgcacgaccggtgctcgatttagactcatctacaggggaaagggggtgggtccacggaggcagaactctgggtgtctcaccatggcctggatccctctacttctccccctcctcactctctgcactaggctctgaggtccgttcctatgagtcttaggacacagccaccctcggtagtcagtcgtccccgagggacaggacggggccagggactcacctggcctcctgcagatggactgaccaaagaatntgcttattgtaccaanagaagccaggccaggcccctgtcgttagngatatataaaggacacgtgaggacggccctcaggtagtactccccgtggagacggtaatttcgtacgtaggtcctaccagtctacgagggacacggcacgtccacgttgactatcaagtagaatccaaggcaaggtaggacgaggctagacttaattacngtaaccaagtagtacgagaaggtaggtacgtacttgtagttgggtacgttacgggagggtagggaaccaagggccgttacgggacccgttacggtacggtacgaaccggtcccgtaaggtcccttcccggtccccgttaccggg

SEQ ID NO: 202194 - DNA, 699 bp, Homo sapiens
  misc_feature: GYAE6OF02FF0U3.21.46.E02.1.454.CMB.1.raw
  modified_base (259)..(259): a, c, t, g, unknown or other
  misc_feature (259)..(259): n is a, c, g, or t
tcagtcgtcgctcgcacgaccggtgctcgatttagactcatctacagggaaagggggtgggtccaggaggcagaactctgggtgtctcaccatggcctggatccctctaccttctccccctcctcactctctgcacaggctctgaggcctcctatgagctgaccacagtcccaccgtcggtgtcagtcgtaccccgaggaccacggacggccaggactcgacctgctcgtgccagatcggactcgaccaaagaaacttntcgtacttacgttacggaaccaacgacggacgccgacggtcccgaacggtcccccgttaggttacgttaacgtacgtaataacgttaaataaaccgtactacgtacggaacggtaccggacccctagtaacggaacgtaccttacccggtagacggtactctttccgtacgtcggtacctaccgacggtcgtacggaacggacacggtacctacgttaccgtacgtacgtacttagcgaggttaacgaccggtaccggagacgaacgggacggacgacggtactacgtaacttacgtacgtaggtaacaaacgtagtagacgtaagtacgttacgttacgtacgttaggtcggtacggtacgggaccggagaccggtaagtccgtaccggtaccgtcgacggacgacccggtaccgccgccgtcccggtcccttacccgg

SEQ ID NO: 202195 - DNA, 596 bp, Homo sapiens
  misc_feature: GYAE6OF02I890Q.21.46.E02.1.454.CMB.1.raw
  modified_base (491)..(491): a, c, t, g, unknown or other
  misc_feature (491)..(491): n is a, c, g, or t
tcagtcgtcgctcgcacgaccggtgctcgatttagactcatctacagggaaagggggtgggtccaggaggcagaactctgggtgtctcaccatggcctcggatccctctacttctccccctcctcactctctgcacaggctctgaggcctcctatgagctgacacagccaccctcggtgtcagtcgtccccaggacagacggccaggactccacctgctcgtgcagatggactgaccaaagaatatgacttattggtaaccaacagaagccaaggccacggcccctgtacgtagtgatatataaagacactgagacggccctagagagaacgtcccgtgagcattcgcttggcctcgagctcgaggacagcacgtcgacgttcgtactagtaccagtacgtaacgtccgaagaccgaggaacggacggagtacgtagtacttaacttacgtacgtaacaaacgtagtaacgacgtaagaggtaacgttacncgttaagtggggttacgttacgggacgggtacgggacgtaacggtacacggtaccgtacgtaggtaccgtacgaacccgtacggactacccggcccgttacccgg

SEQ ID NO: 202196 - DNA, 251 bp, Homo sapiens
  misc_feature: GYAE6OF02I55H5.21.46.E02.1.454.CMB.1.raw
  modified_base (237)..(237): a, c, t, g, unknown or other
  misc_feature (237)..(237): n is a, c, g, or t
  modified_base (243)..(251): a, c, t, g, unknown or other
  misc_feature (243)..(251): n is a, c, g, or t
tcagtcgtcgctcgcacgaccggtgctcgatttagactcatctacagggaaagggactggagtggttattattcctggggccagggaaccctggtaaccgtctcctcagcctccaccaagggccatcggtcttcccctggcgccctgctccaggagcacctccgagagcacagcggccctgggctgcctggtcaaggactacttccctcgtctctactgagcgggctgggcaaggcncatagnnnnnnnnn

SEQ ID NO: 202197 - DNA, 571 bp, Homo sapiens
  misc_feature: GYAE6OF02GMFS9.21.46.E02.1.454.CMB.1.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
  modified_base (486)..(486): a, c, t, g, unknown or other
  misc_feature (486)..(486): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccagggactccacctgcctcgtgccagatggacctgaccaaaagaatntgtacttattggtaccaanagaacgccaggccacggcccctgtgttagtgatataataaagacactggagacggccctagtacgagactccccgtgacgcgtattctcgtggctaccgagctcgagggacagcagtaccacgttgactagtcagtagaacgtccgaggacgaacggaggacggaaggctacgtacttagttactgtaaccaaacaggtagaacgagtagagttacntagttggtggttcggcggaggaccgtaaggcctacggaccgttcgtaggtacctacggacccgagtccgtccgcccccgtacggg

SEQ ID NO: 202198 - DNA, 523 bp, Homo sapiens
  misc_feature: GYAE6OF02IYRMH.21.46.E02.1.454.CMB.1.raw
  modified_base (373)..(373): a, c, t, g, unknown or other
  misc_feature (373)..(373): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgcttattggtaaccaacagaagccaggccaggcccctgtgttagtgatatataaagacactgagaggccctcagagatccctgagcgattctctggctcagctcgagggacagcagtcacgttgactancagtgagtcagcagaggacgagctgactattacngtacaagagtaganagtagagtactagtagttgggtgttacgggcggtagggaccaaggcgtacggaccgttaccgtaggtacgacgacccgaaggcgtacccgccccgttaccgg

SEQ ID NO: 202199 - DNA, 683 bp, Homo sapiens
  misc_feature: GYAE6OF02JNIFY.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtagggtccaggaggacacgaactctgggtgtctcaccatggcctggatccctctacttctccccctcctcacgtctctgcacaggctctgaggcctcctatgagctgacacagccaccgtggtgtcagtcgtacccgaggacagaccggccaggactccaccgtgctctgcagatggactgaccaaagtaatntgtacttagtcggtaccaacgtagaacgacacggaccacggcccctgtcgttagtgatatagtaacggacacgtagacgacggccctacgacgacgactccgtagacgacggtaacttcctacgtcgctacccgtagtaccgtccgaacgggtaccacggtactacggttacctacggtttacgtaacgttacgttaccgaaggttaacgacggttccaacggtacaagggacggtacggacgggtacgtacgtaacgttacgttacgtacgtaacaacgttaagtacgtaacgtacggttaaggtaacggtttactcgtagtttacggggtacgttacggggacggtacgggacgtaacggtacgtacggtaccggttacgtacgggtacgacggtacccggtaacggtccgtaccggtaccccgttacggg

SEQ ID NO: 202200 - DNA, 618 bp, Homo sapiens
  misc_feature: GYAE6OF02H47CL.21.46.E02.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaatatgacttattcggtaaccaaacagaacgccgaggccacggcccctgtgttagtgatatataaagacacgtgagacggccctanagagactcccgtgacgcgtactttctcgtcggtcctaccgagtccgtacgaagggacacgcacgtccgtaacgttgaactagtcgagtagaacgtccgaggcgaggaggacgagctagacttattactagaacaaacgtaggtaacgacgtaaggtagagttacctagtaggtttgggtcggttcgggacgggtaacgggaaccgaaggtccgtacgggtaacccggtttaccgtacgggttaccaccgggtaaccccgaacgggtcccgttccccggacccccgttacccggg

SEQ ID NO: 202201 - DNA, 579 bp, Homo sapiens
  misc_feature: GYAE6OF02FIIOO.21.46.E02.1.454.CMB.1.raw
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgctctgcagatggactgaccaaagaaatntgcttatggtaaccaanagaagcaggccagccctgtgttagngatatanaaagacactgagacggccctagagagactcccgtgacgcgacttctcgtcggtcctacgacgctacgaggacagcagtcacgttnactancgagtagtaacgtcgagacgaggacggacgaggtcgagtactattacgtagtacaaagtagacgacgtagtacgaaggttactacgtaggttcgggttacggtcgggacgggagggtaaccgaaggtcgtacggtacccgttaccggtacggtaccgtaccggacccggtaacggtccgtacccggcccccgttaccgg

SEQ ID NO: 202202 - DNA, 705 bp, Homo sapiens
  misc_feature: GYAE6OF02J0DRI.21.46.E02.1.454.CMB.1.raw
  modified_base (467)..(467): a, c, t, g, unknown or other
  misc_feature (467)..(467): n is a, c, g, or t
  modified_base (532)..(532): a, c, t, g, unknown or other
  misc_feature (532)..(532): n is a, c, g, or t
  modified_base (583)..(583): a, c, t, g, unknown or other
  misc_feature (583)..(583): n is a, c, g, or t
tcagtcgtcgctcgcacgaccggtgctcgatttagactcatctacagggaaagggggtaggggtccgacggaggcgagaactctgggtgtctcaccatggcctggatccctcctacttctccccctcctcactctctgcacacggctctgacggcctcctatgagctgacacacgccaccctggtgtctagtcgtccccaggacaggacgccgaggatccgaccctgccgtctgcagtagtcggactcgaccaaaagtaatatcgtacttagttaggaaccaacaggtaagccgaggacccgacggccccttggttaggttagtcggtaactaagtaactaaaggaccagttcggaagccggtcccctgaacgtagaccttaccgtcggaggtaccgattttccgacggtcgaacctttccgaagttccgaccgtagggaaccagtactacggttctaaccgggttnacgttagtacgtacggtagtaaccgcgtaggcgtaacggacggtacggacggtcgtagtaacgtnttaacgtcgtaacgaaacgtacgagacggtagtacggtacgtacgttacgnggttttagggtcgttaccggggacgtaacgggtactaaccgggtacttacggtcccttaacgggtaccgttaccgggaaccgacccgggtaacggtcccgttacccggaccccggttaccgg

SEQ ID NO: 202203 - DNA, 547 bp, Homo sapiens
  misc_feature: GYAE6OF02IO9VF.21.46.E02.1.454.CMB.1.raw
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacccctcggtgtcagtgtccccaggacagacggccaggatcacctgctctgcagatggactgaccaaaagaaatatgcttattggtaaccaacagaagccaggccaggcccctgtgttagtgatatataaagacactgagaggccctcagagactccctagagcgattctctggcctcagctcgagggacagcagtctacgttgacttatacagtgaacgtccgaggcaggaggacgaggctagactattacngtaacaaanagtaagactagtaggaacgttactacgtagttaggggtgttcgggcgggtaagggaccgaaggcctacggaccgttccgtaggtcacggacccgaaggccctccggcccccgttcgg

SEQ ID NO: 202204 - DNA, 510 bp, Homo sapiens
  misc_feature: GYAE6OF02HARBO.21.46.E02.1.454.CMB.1.raw
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgacttattggtaaccaacagaagccaggccaggccccctgtgttagtgatatataaagacactgagaggccctanagagatccctgagcgattctctgctccagctcgagggacagcagtcacgttgactatcagtgaacgtcaggcagaggacgagctagactattactgtacaagagtagacagtagagtactgtagttggtgttggcggaggacgaacggcgtcgaccgtcgtaggtcacgcccgaaggcctcgccccgtccgg

SEQ ID NO: 202205 - DNA, 566 bp, Homo sapiens
  misc_feature: GYAE6OF02HLSDJ.21.46.E02.1.454.CMB.1.raw
  modified_base (241)..(241): a, c, t, g, unknown or other
  misc_feature (241)..(241): n is a, c, g, or t
  modified_base (425)..(425): a, c, t, g, unknown or other
  misc_feature (425)..(425): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgatatataaagacactgagaggccctcagagactccctgagcgattctctggctccagctcgaggacagcagtcacgttgactatcagtgaacgtcgaggcaagaggacgaggtctgaacttattactgtaaccaaagngtaagacaggtagacgtactcgtagtttgggtagttcgggacgggtagggtaacccgaaggtacctacgggtaaccgttacccggtaggttaccgaacggtacccgtaacgggtcccgttccggtaccccccgttaccggg

SEQ ID NO: 202206 - DNA, 566 bp, Homo sapiens
  misc_feature: GYAE6OF02GQDRV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttagttcggtaccaacagaagccaggccacggcccctgtgttagtgatataataaagacactgagacggtaccctcgagagtactccctagacgcgtatttcctcgtgccttccagtcctcgaacgggacaggcagtcacgttgactagtcagtgaagtccaggcaggaggacgaggtctagacttagttactgtacaaacgtagtaagacgtaaggtagtacgttactgtagtttgggtgttacgggacggtagggaccgtaaggtcgtacgtaccgttcgtaggtccgacgtaccgtaacggcctaccgccccgtaccgg

SEQ ID NO: 202207 - DNA, 728 bp, Homo sapiens
  misc_feature: GYAE6OF02I1ONH.21.46.E02.1.454.CMB.1.raw
  modified_base (334)..(334): a, c, t, g, unknown or other
  misc_feature (334)..(334): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgtcttagttggtaacaacgagaacgccgaggccacggcccctggtacgttagtgtataataataaacgacacgtaggaggacggccctanacggtagtacctacccgtaggacgcgtactttctcgtcggccttccacgtcctacggaacgggacacgactacgttcgtaacggttcgaacttaacgtcgaaggtagtaacggtaccgaacgggtacgaaggggacggaaccgggaacggtacgttacgtaacgtttaacgtttacgtacgtaaaccgaaaacgtaggtaacaaggtaacggttaacggtacggttaaccttaggttacggttttacgggggttacgggttaccgggacggggtaccgggaaaccggttaacgggtaccggttaacgggtaccccgggtttacgtaaccggggttaccgaaccgggtaccccggtaagggttaccccggttacccggtccccccgttaccgggg

SEQ ID NO: 202208 - DNA, 686 bp, Homo sapiens
  misc_feature: GYAE6OF02IOQIG.21.46.E02.1.454.CMB.1.raw
  modified_base (245)..(245): a, c, t, g, unknown or other
  misc_feature (245)..(245): n is a, c, g, or t
  modified_base (273)..(273): a, c, t, g, unknown or other
  misc_feature (273)..(273): n is a, c, g, or t
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatccacctgctctgcagtatggactgaccaaaagtaaatntcgacttagttggtaaccaacgagaacnccgacggtccgaaggccccttaggtgttacgtagagtataataaacganacctgaacgacgccctagagagtcacctgagcgtattacgtcgtacgccttaccgagtccgtacgacgggaacgtacgcgtacgtacgtacgttacgacgtactacgtaagttacgaacgttacccgaaggtacgaacgggaacggaacggacgggtactacgtaacgttacgttacgttaacgacgaaacgagttaacgaaccgtaagtagaacggttactacgtagttacgggttcggttacgggccgggaacgggtacccgtaacggtaccgttcgggtaaaccccgttccggttaacggttaccggacccgggttaaccccgtaagggtccccggtacccggttccccccgttaaccggg

SEQ ID NO: 202209 - DNA, 513 bp, Homo sapiens
  misc_feature: GYAE6OF02GG7RT.21.46.E02.1.454.CMB.1.raw
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagagccctnagagatccctgagcgattctctggcctccgagctcgaggacagcagtcacgtgactancagtgaacgtcaggcaggacgacgaggctagactattacngtacaacnganacagtagagtactagagttgggngtcggaggacggaccgaagccgtagaccgttacgtaggtcgacgaccgaaggcgtaccgccccgtacgg

SEQ ID NO: 202210 - DNA, 723 bp, Homo sapiens
  misc_feature: GYAE6OF02IZO25.21.46.E02.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtggggtccgaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaaggccaggccccctgtcgttagcgtataatataaagacactagacgacggccctnaacgacgactaccccgtaggacgtcggtaacttccgtacgttcggacgttcccagccgtcaaacgggggtaccaaggtccgaaggttacgaccgtttaggtaacccgttaagtccgaaagttaccggtaaaggttacccgaacgggtacgaacgggtaacggggaaccgaaggggttacctacggttaaaccgttagtttaaccgttacgtaaccgttaaaaaccgacggtttaaacggaacgtaacggttacgaaacggtttacgtaccgttaagtttcggggttacgttacggggacggtaaccggggtacgtaacgggtaccgttcggaaccccgttcgtaacgggttccaacgggtccccgaaagggtccccttacgggtccccccgttaacccggg

SEQ ID NO: 202211 - DNA, 624 bp, Homo sapiens
  misc_feature: GYAE6OF02G69R1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgtcttattggtaaccaacagaagccaggccaggcccctagtcgttagtgatataataaacggcactgagaggccctagagagactcccgtagacgcgtaattctctggctccagcctacgagggactagctacggtactacggtttacgaacttacgtaccaggttacggaaacggttcccgaagggcccgaagggaacgggaacggtaagggaccttacggtaacttaacgttaacgtacggtaacaaaacgtagtaacgacgtaagtaggtaacgttactacgtaggttagggtacgttcgggacggtagggaccgtaaggcctacggacccgttacgttaggccgacggaccgaacggtcctccggccccgttacgg

SEQ ID NO: 202212 - DNA, 513 bp, Homo sapiens
  misc_feature: GYAE6OF02FVW3A.21.46.E02.1.454.CMB.1.raw
  modified_base (313)..(313): a, c, t, g, unknown or other
  misc_feature (313)..(313): n is a, c, g, or t
  modified_base (420)..(420): a, c, t, g, unknown or other
  misc_feature (420)..(420): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggccccctgtgttagtgatatataaagacactgagaggccctnagagatccctgagcgattctctgctccagctcgagggacagcagtcacgttgactatcagtgaagtcaggcagaggacgaggctgacttagtactgtacaaatgtanacgagtagagtactntagttgggtgttcggnggtaggacgaagctacgaccgttccgaggtccacgacccgaggcctaccggtcccctaccgg

SEQ ID NO: 202213 - DNA, 621 bp, Homo sapiens
  misc_feature: GYAE6OF02FMIA3.21.46.E02.1.454.CMB.1.raw
  modified_base (244)..(244): a, c, t, g, unknown or other
  misc_feature (244)..(244): n is a, c, g, or t
  modified_base (380)..(380): a, c, t, g, unknown or other
  misc_feature (380)..(380): n is a, c, g, or t
  modified_base (427)..(427): a, c, t, g, unknown or other
  misc_feature (427)..(427): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagattcattgacctaaaaaattnttgtttttaggaccagtcagaagtcaggccaggcccctgtgttggtcatccatgaggacaggagacgaccctccgggatccccgtgagagattctcgtggcctccaactcgagggacggtgctacggtgattcgtnaggtcggggcccagggtggaggagtgagctgactactacgtgttacncgagcagacagcaggtggtcacgtacggacgggggtactacggtttcgggaccgggagggaacccggtagggttacggacccggttaccgtacggtaccgacggtaccccgaacgggtccttacccggccccccggttacccggtccgacccgtttcccgtaccggtttaccccccgaccccgttttccccccg

SEQ ID NO: 202214 - DNA, 510 bp, Homo sapiens
  misc_feature: GYAE6OF02F0IJ5.21.46.E02.1.454.CMB.1.raw
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaaagaaatatgcttattggtaccaacagaagccaggccaaggccccctgtgttagtgatatataaaagacactgagaggccctcagagatccctgagcgattcnctggctccagctcagggacagcagtcacgttgactancagtgaagtccaggcagaggacgaggctgactattactgtacaaactagtagacaagttagaggttaactcagttgggtgttcggcggagggaccaagcgtgaccgtcctaggtcacgcccaaggctcgcccctcgg

SEQ ID NO: 202215 - DNA, 506 bp, Homo sapiens
  misc_feature: GYAE6OF02G6JZH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttagtgatatataaaagacactgagaggccctcagagatccctgagcgattctctggctccagctcagggacagcagtcacgttgactatcagtgaagtccaggcagaggacgaggctgactattactgtacaaacagtagacagtagagtactcagttgggtgttcgggcggagggaccaaggctgaccgtcgtaggtcacgcccaggctcgccccgtaccgg

SEQ ID NO: 202216 - DNA, 567 bp, Homo sapiens
  misc_feature: GYAE6OF02FORY1.21.46.E02.1.454.CMB.1.raw
  modified_base (240)..(240): a, c, t, g, unknown or other
  misc_feature (240)..(240): n is a, c, g, or t
  modified_base (378)..(378): a, c, t, g, unknown or other
  misc_feature (378)..(378): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatntgcttattggtaccaacagaagccaggccaggcccctgtgttagtgatatataaagacactgagaggccctcagagatcccctagacgcgattctcgtggcctccagcctcgaagggtacagcagtcacgttgactancagtgaagtccaggcaggaggacgaggctagactattacgtgtacaaactagtaagactagtaggacgttactacgtagttgggtgttacgggacgggtacgggaaccgaaggccgttacggaacccggttaccgtagggttaccaacggacccccgtaaggtcccgttacccggcccccgttaccggg

SEQ ID NO: 202217 - DNA, 583 bp, Homo sapiens
  misc_feature: GYAE6OF02GEVL4.21.46.E02.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggcagacgccaggntcacctgctctgcagagtggactgaccaaaagaatatgcttagttggtaaccaacaagaagccgaggccacggcccctgtgttagtgatataataaagacacgtggacgaggtccctcgaagagactcccgtagagtccgtattcctcgtggccttccgagctacgagggcaggctagctacgttgactanctagtcgacgtccgagcgaaggaggacgaggactcgtattaattactgtaacctaagtagtaagacgtaagtagtaacgttactagtagttgggttggttccgggagggacgggtaaccgaaggtccgtacggtacccggttacgtaacgggtcaccggaccggaacgtcccgtacccgtccccgtcgg

SEQ ID NO: 202218 - DNA, 639 bp, Homo sapiens
  misc_feature: GYAE6OF02GUZXO.21.46.E02.1.454.CMB.1.raw
  modified_base (323)..(323): a, c, t, g, unknown or other
  misc_feature (323)..(323): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgcagatggactgaccaaaagaatatgtacttattggtaaccaacagtaacgaccacggccacggacccctgtagttagtgatatataaagacactgagacggcctnagagactcctagacgcgtattctacgtcgtcctccagtctacgagggtacagcgaacgtctaacggttgaaccttatacgtagtacgaacgtaccgaggtacgaagggacggacggaggtacgacgtacttaacgttactacgttacaaaacgttacgtaagaccgtaaggtacgtaaggttaacctacgttagttcggggttaggttaccgggacggggtaaccggtacggaacggtccggttaacggtaccccggttaccgtaaccggtcgtaccggacccggtaacggccgttacccggcccccgttacccgg

SEQ ID NO: 202219 - DNA, 609 bp, Homo sapiens
  misc_feature: GYAE6OF02ICIA6.21.46.E02.1.454.CMB.1.raw
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggcaggctcacctgctctgcagatggactgaccaaaagaatntgtacttattacggtaccaaacagaacgccgaggccacggtcccctgttacgttagtgataattaataaacgacncgtaggacggacgtccctagagacgacctccgagacgtcgtattctcgtggcctcgagtcacgacgggacagacgacgtcgtaacgttcgactactactacgtaggtaacgtcgaacggagaacggtagggaacggacggtaccgtagtaaccttagttaacgtacgtaaccgtaaagagtaacgaacgtaagtaaggtacgtactagtaggttggggtacgtcgggaggtacggacgaacggtccgaggtaccgtcgtaggccgacgacccgtaggcctccggtccctaccgg

SEQ ID NO: 202220 - DNA, 570 bp, Homo sapiens
  misc_feature: GYAE6OF02G85JA.21.46.E02.1.454.CMB.1.raw
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
  modified_base (431)..(431): a, c, t, g, unknown or other
  misc_feature (431)..(431): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgacttattggtaaccaanagaagccaggccaggcccctgtgttagtgatatataaaagacactgagaggccctnagagatcccctgacgcgtattctctggctccgagctcgaggacagcagtcacgttgactatcagtgaagtcaggcagaggacgaggctagactatactgtacaaactagtacganagtagtaacggtactacgtagttgggttgttaccgggacgggaacgggaacccgaaggtccgtaacgggtacccgttaccgttaagggtcccgaacggtcccgtaaacgggtcccgttaccggtccccccgttaccggg

SEQ ID NO: 202221 - DNA, 520 bp, Homo sapiens
  misc_feature: GYAE6OF02JGR37.21.46.E02.1.454.CMB.1.raw
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
  modified_base (416)..(416): a, c, t, g, unknown or other
  misc_feature (416)..(416): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctnagagactccctgagcgattctctggctccagctcagggacagcagtcacgttgactancagtgaagtccaggcagaggacgaggctgacttattactgacaaangtagacagtagagtactgtagttgggtgttcgggcggagggaccgaaggtctacggacccgttcgtaggtcacggtacccgaaggtcctccggtcccccttcgg

SEQ ID NO: 202222 - DNA, 712 bp, Homo sapiens
  misc_feature: GYAE6OF02FHHJ2.21.46.E02.1.454.CMB.1.raw
  modified_base (167)..(167): a, c, t, g, unknown or other
  misc_feature (167)..(167): n is a, c, g, or t
  modified_base (265)..(265): a, c, t, g, unknown or other
  misc_feature (265)..(265): n is a, c, g, or t
tcagtcgtcgctcgcacgaccggtgctcgatttagactcatctacagggaaaggggtgggtccaggaggcagaactctgggtgtctcaccatggcctggatccctctacttccctcccctcctcactctctgcacaggctctgacggcctcctatgagctcgacacncgcccaccgtcggtgtcagtccgtcccgaggacaggaccggccgaggactccaccgtgccttcgtgacagtagtcggactcgaaccaaaagtaaattntcgtacttttagttcggtaaacccaaacgaagaacgaccgacggaccgacggcccccgttggttacggttagtcgtaattaataaagtaaaacgaacctaacgttaggaaggacgtcccctagaacggaagaccttccccgtagacggtacgtactttcctcgtcggcctaccgacgcctcggaacgggacacgctacgtacgtacgtacgacttaacgcgtaggtagtaaccgaccgacggacgtaaggacgggaacgacgggtctacgtaacttaacgttactacgtaaaccaaacgtaggtaacgaccgtaaggtacggtaacgtacctagtaacggttgggttacggttcgggacgggaacgggaaccgtaaggcgtaccggtaccgttacgtaacgggtccaccggtaacccggacgggtcctccccggtccccgttaccgg

SEQ ID NO: 202223 - DNA, 633 bp, Homo sapiens
  misc_feature: GYAE6OF02IF68R.21.46.E02.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctgcagagtcggactcgaccaaaagaaatatgtactttagttaggtaaccaacagaacgccaggccacggccctgtgtagtgatataataagacatgagacggccctanagagactccgtagacgcgtacttcctcgtcggcctaccagtcgtcgtaagggacagcagtcgtacgttacgacttacgtacgaggtacgaacgttaccgaggtacgaagggaaggacggaggtctaaggtacttagttacgtcgtaacgaaacgtaggtaacgaacgtagtaaggtacggttaactacgtaggtttacgggtcggtttacgggacgggtaacggaaccgtaacggtccggtacggtacccggttacggtacggtaccgaccggacccgtaacgggtcctaccccggccccgttaccggg

SEQ ID NO: 202224 - DNA, 636 bp, Homo sapiens
  misc_feature: GYAE6OF02JY4CI.21.46.E02.1.454.CMB.1.raw
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatntgcttattggtaccaacagaagccaggccaggcccctgtgtagtgatatataaagacactgaacgaggccctnagagatcccngagcgattctctggctccgagctacgagggacagcagtcacgttgactatcagtgaagtccaggcacggaggacgaggctagacttattacagtaccaaacgagtaacgacgtaaggtaacgtaacggttaactcgtagtttacgggggttacgtttaccggggacggggtaacggtaacccggtaacgggtaacccgtttagggaacccccggtttacccggttaaggggtttacccggtaaccgggaacccccggttaaacgggggtccccgtttaccccggggtaccccccccggttttaacccgggg

SEQ ID NO: 202225 - DNA, 641 bp, Homo sapiens
  misc_feature: GYAE6OF02I53BV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgacttattggtaaccaacagaagccaggccacggcccctagtgttacgtgatataataagacactagagacggccctagagagactccctgacgacgtacttctcgtacggctccagcctacgaggtacagacgagtactacgttaggaccttatacgagtacgaacgtccgagggacgaaggacgggacggacggtcgtagactttagttacctcgtaacaaacgagtaacgacgaagtacggaagttaccgtagtacggtttagggtacgggttccgggacgggtacgggaaccgtaagggtaccttacgggaaccccggtttaccggtacgggttaaccgacccgggttaaccccgtaacgggacccctttcccggggacccccccgtttacccggg

SEQ ID NO: 202226 - DNA, 582 bp, Homo sapiens
  misc_feature: GYAE6OF02F6T9P.21.46.E02.1.454.CMB.1.raw
  modified_base (332)..(332): a, c, t, g, unknown or other
  misc_feature (332)..(332): n is a, c, g, or t
  modified_base (451)..(451): a, c, t, g, unknown or other
  misc_feature (451)..(451): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatagtggtacttagttcggtaaccaagagaaggccaaggaccacggccccctggtgttagtgatataataaagacactagagaggccctanagagtactcccgtgacgcgtatctcgtgctccgagctacgaggacagcacgtcgtacgttcgactatacgagtacgaagtccgaggtacgaggaggacgaggcgtagacttattacgtntacgaaactagtaagactaagtagtaacgtactcgtaggtttagggtcggttacggcgggaacgggacgtaaggtcgtacggtacccgtacgtaacggcacgaccgtaggtcccgtccgacccccgtacgg

SEQ ID NO: 202227 - DNA, 774 bp, Homo sapiens
  misc_feature: GYAE6OF02JWTJE.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggactcacctgctctgcagatggactgaccaaaagaatatgtacttattcggtaaccaacgaagaagccgaacggaccacggtcccctgtcgttagtacgaatactaataaagactacgtaggaacggacggccctacgaaggaacgacctcccgtaggaacgtccggtaatttccgttaccgttcgtaccgttacccgacgtccgttaccgaaggggtaccgaacggaccgtaacggtaccgtaaccgtttacggaaccgttaacgtactacggtaacggtaacggttaccccgaagggaccgaaaggaacgggtaacggacgggacgtacggttaacgttaacgtttacggtacgtaaaccgtaaacggtaacggtacgtaacgtaaacgggtaacggttaacgggttaaccttaggttaacgggtttaggggttacgggttacggggaccgggttaaccggggtaaccgaacgggttaccgttacgggaacccggtttacgaacggggttacccgtaccggtacccggtaaccgggtcccgtacccggtccccccggttaaccgg

SEQ ID NO: 202228 - DNA, 650 bp, Homo sapiens
  misc_feature: GYAE6OF02I2VF9.21.46.E02.1.454.CMB.1.raw
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgagcctcctatgagctgacacagccaccctggtgtcagtcgtccccgaggacagacgccaggactcacctgctcgtgacagntcggactgaccgaaaagtaatagtgtacttattacggtaaccaanagacgaccaggccgacggccctagtgttacgtagattataagaacgtacacgtagacgacggtccctagacgagactaccgtgacgtctacgtactcgtacggccttaccgagtacgtcgacgggacagtcaacggtctaacggttcgactacgtactaggtacgtaacgtccgaagggacgaacggtaagggacgacgttacgtacgtacttacgtacgttacgtacgaaacgtagtacaccgtaaggtacgtacgttacgtagtaggttacgggttacggttacggacgggttaacggaaccggtaacgtcgtacggtaccgtacggttacggtacgtaacccgtaccggtacggtaccctccggtaccccgttaccggg

SEQ ID NO: 202229 - DNA, 558 bp, Homo sapiens
  misc_feature: GYAE6OF02H0GQJ.21.46.E02.1.454.CMB.1.raw
  modified_base (319)..(319): a, c, t, g, unknown or other
  misc_feature (319)..(319): n is a, c, g, or t
  modified_base (391)..(391): a, c, t, g, unknown or other
  misc_feature (391)..(391): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgctttattggtaccaacagaagccaggccacggcccctgtgttagtgatataataaagacactgagacggccctnagagactccctgagcgtaattcctctcggcctccgagctacgaagggacagctaagtccacgttagacttancaggtgaacgtcaggacaggaggacgagctgaacttattacgngtaacaaanagtaagacgtagtaggtagtactgtagttgggtgtacggcggaacgggacgaaggtccgtcggtacccgtacgtaggtcaccggacccgaacggcgttacccgccccgttaccgg

SEQ ID NO: 202230 - DNA, 551 bp, Homo sapiens
  misc_feature: GYAE6OF02GP0OG.21.46.E02.1.454.CMB.1.raw
  modified_base (355)..(355): a, c, t, g, unknown or other
  misc_feature (355)..(355): n is a, c, g, or t
  modified_base (411)..(411): a, c, t, g, unknown or other
  misc_feature (411)..(411): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgctttattggtaccaacagaagccaggccaggcccctgtgttagtgatataataaagacactgagacggccctgagagactccctggagcgtattctcgtggcctcagtcncgagggacagcagtcacgttgactatcagtgaacgtcagacgaggacggacgaggntacgacttattactacgtaacaaacgtagtaacgaagtagtaagacgttactagtagttgggtcgtacgggacgggacggacgaagccgtacggaccgttaccgtaggtcaccgaccgacggctcccggccccgtaccgg

SEQ ID NO: 202231 - DNA, 510 bp, Homo sapiens
  misc_feature: GYAE6OF02FY15M.21.46.E02.1.454.CMB.1.raw
  modified_base (316)..(316): a, c, t, g, unknown or other
  misc_feature (316)..(316): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctttggtgtcagtgtccccaggacagacggccaggatcacctgctctgcagatggactgccaaagaaatatgcttattggtaccaacagaagccaggccaggccccctgtgttagtgatatataaagacaactgagaggcccctnagagatccctgagcgattctctggctccagctcagggacagcagtccacgttgactatcagtgaacgtccgaggcaggaggacgaggctagactattactgacaaacngtaganagtagagtaactcattgggtgttggcggaggaccgaagcgtgaccgtctaggtccagcccgaaggctacggccccttcgg

SEQ ID NO: 202232 - DNA, 780 bp, Homo sapiens
  misc_feature: GYAE6OF02F7U8T.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgcttattggtaaccaacagaagccaggccaggcccctgtgttagtgatataataaagacactgagacggcctacagagatcccgtgagcgtacttcgtctcggccttccgagtccgtacgaacggggacacgccgaggttaccgtacgttacgaacttatacgtaaggttacggaaacggttacccgacggggactaacgggaacggggtaaccgagggtactacggtaacctttaacgttaacgtacgttaaccaaaacggttaaggtaaaccggtaacgtaaacggggttaacggtaacgggtttaaccgtaacggtttaacgggttttcgggggttaccggggttttaccgggggacccgggggtttaacgggggaaaccccgtaacgggttaccccgggtttaaccggggttaaccccccggggtttaaccggtttaaacccgggggttaccccggtaaaccggggttaaccccccgttaaacggggggtcccccgtttacccccgggtaccccccccgggtttacccgggg

SEQ ID NO: 202233 - DNA, 651 bp, Homo sapiens
  misc_feature: GYAE6OF02IW98V.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtcgtccccaggacagacggccaggatccacctgctctgcagagtggactgaccaaaagtaaatatgtactttagttacggtaaccaaacgaagaaacgcccgaacggcccgaacgggcccccctaggttaggtttaagttggaattaaataaattaaaacgactacgtagaaggacgcccctagagacgtactcccgtaggacgcgtacttctacgtcggcctccagtctacggagggacacgcgagttcaacgttgacttatcgaagtagaagtaccgaggcgaagaaggacgaggtacctagacttaattacgtacaactaaacgagtagaacgtaagtagtaacgttacgtagtaggtttgggtcgttacgggacgggtaacgggaaccgtaaggtaccgtaggtaacccgttcggttaggtaccgacggtacccggaacggtccgttacccgcccccggttacg

SEQ ID NO: 202234 - DNA, 266 bp, Homo sapiens
  misc_feature: GYAE6OF02FHN5W.21.46.E02.1.454.CMB.1.raw
  modified_base (241)..(241): a, c, t, g, unknown or other
  misc_feature (241)..(241): n is a, c, g, or t
  modified_base (247)..(266): a, c, t, g, unknown or other
  misc_feature (247)..(266): n is a, c, g, or t
tcagtcgtcgctcgcacgaccggtgctcgatttagactcatctacagggaaaggggactggagtggttattattcctggggccagggaaccctggtaaccgtctcctcagccctccaccaagggcccatcggtcttccccctggcgccctgctcccaggagcacctccgagagcacagcggccctgggctgcctggtcaggacctacttcccgagcgacgactgagcgggctggcaaggcncatagnnnnnnnnnnnnnnnnnnnn

SEQ ID NO: 202235 - DNA, 575 bp, Homo sapiens
  misc_feature: GYAE6OF02FZKZI.21.46.E02.1.454.CMB.1.raw
  modified_base (314)..(314): a, c, t, g, unknown or other
  misc_feature (314)..(314): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccaggcccctgtgttagtgatatataaagacactgagaggccctnagagatccctgagcgtatttcctctggcctccagctacgagggacaagcagtcagttgactatcagtgaagtccaggcaggacggacgaggctagtactattacgtagtacaaagagttacgagtagtagaggttactcaggtttgggtcggtttacgggacggtagggtaaccgaaggtcctaccggaacccggttccgttaacgggttacccaacgggtaccccgaacgggtcccgttacccgccccccgttacccggg

SEQ ID NO: 202236 - DNA, 563 bp, Homo sapiens
  misc_feature: GYAE6OF02IQ97M.21.46.E02.1.454.CMB.1.raw
  modified_base (242)..(242): a, c, t, g, unknown or other
  misc_feature (242)..(242): n is a, c, g, or t
  modified_base (364)..(364): a, c, t, g, unknown or other
  misc_feature (364)..(364): n is a, c, g, or t
  modified_base (427)..(427): a, c, t, g, unknown or other
  misc_feature (427)..(427): n is a, c, g, or t
  modified_base (457)..(457): a, c, t, g, unknown or other
  misc_feature (457)..(457): n is a, c, g, or t
tcagtcgtcgctcgcacgaccggtgctcgatttagactcatctacagggaaagggggtgggtccaggaggcagaacctctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaaccaacagaagccaggccaggccccctgtgttagtgatatataaagacactgagacggccctacagagactccctgaagcgattctctggctccgagtctcgagggaacngtacagtacacgttgacctatcgaagtcgaagtccaggcaggaggacgaggctgactattacntaccaaatagagacgaagtaggagttaacncgtaagttgggttacgttcggggacggaaggggaccaaggtcgtacggacccggttaccgagggtcacggtacccgaaggtcccgttacccgccccggttaaccgg

SEQ ID NO: 202237 - DNA, 577 bp, Homo sapiens
  misc_feature: GYAE6OF02HBP9X.21.46.E02.1.454.CMB.1.raw
  modified_base (371)..(371): a, c, t, g, unknown or other
  misc_feature (371)..(371): n is a, c, g, or t
  modified_base (423)..(423): a, c, t, g, unknown or other
  misc_feature (423)..(423): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggcccctgtgttagtgatatataaagacactgagaggccctacagagactccctgagcgattctctggctcagctcgagggacagcagtccgagttgactntcagtgaagtcgaggcaggaggacgagctaggacttagttcgtagacaaacnggtaacacgtaaggtaagaggttactacgtaggtttggggtaggtttccgggacgggtaacgggtacccgtaagggtccttaccgggtaaccccggtccgttaaggggtccaaccgggtacccgagggtcccgttaccggccccccgttccggg

SEQ ID NO: 202238 - DNA, 815 bp, Homo sapiens
  misc_feature: GYAE6OF02H3OCS.21.46.E02.1.454.CMB.1.raw
  modified_base (241)..(241): a, c, t, g, unknown or other
  misc_feature (241)..(241): n is a, c, g, or t
  modified_base (261)..(261): a, c, t, g, unknown or other
  misc_feature (261)..(261): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatntgtacttattcggtaccaanagaagcaggccacggcccctgtgttagtgatatataaagacactgagacggccctgagagactcccgtagacgcgtactttcctacgtcgggcctaccgacgtccgtacgacggggtaacaggccgtaacggtaccgtaaccggtttacgaaccttaacgttaccgtaagggttaacggtaaacggttacccgaaggggtaccggtaaacgggaaggggaaaccgggtaacggggtaccgttaacgggttaaacgtttaacgttttaaaccgttacggttaaaccgtaaaaaccggttaagggttaaacggtaaccggtaaaggttaacgggtaaacgggttttaaccgttacggttaaagggtttcgggggttttaacgggtttaccggggaccgggggtaaccggggtaaacccggtaaggggttacccggttaaccgggttaacccccgggtttaacccgttaacgggggttacccgtaaacccggggtaccccccggtaaaacggggttcccgttaccccccgggttaccccccggtttaacccccgggg

SEQ ID NO: 202239 - DNA, 595 bp, Homo sapiens
  misc_feature: GYAE6OF02GIGTG.21.46.E02.1.454.CMB.1.raw
  modified_base (334)..(334): a, c, t, g, unknown or other
  misc_feature (334)..(334): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggatccacctgctctgcagatggactcgaaccaaaagaaatatgtacttagttcggtaaccaacgaagaaagccaggccacggccccgtgtgttagtgatataataaagacactgacgacgccctanagacgactcccgtgacgcgtattctcgtggtcctcagctacgagggacagcagtcgtacgttcgactatacgagtagaacgtcgaggtcgaagagggacgaggcgtaggacttaattactgtaaactaacgaagtaacggactaaggtagtaaggtacttagtaggtttgggtgttcgggacgacgggaaccgacggtacctaaccggtaccgtacggtacgacggtacccgaaggccctaccggtcccccgtaggtcccg

SEQ ID NO: 202240 - DNA, 587 bp, Homo sapiens
  misc_feature: GYAE6OF02I0URQ.21.46.E02.1.454.CMB.1.raw
  modified_base (241)..(241): a, c, t, g, unknown or other
  misc_feature (241)..(241): n is a, c, g, or t
  modified_base (445)..(445): a, c, t, g, unknown or other
  misc_feature (445)..(445): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatntgcttattcggtaccaacgagaacgccaggccacggcccctgtagtagtgatatataaagacacgtgagacggccctagagagactcccgtgacgtcgtattcgtacgtcgcttccgagtcctacgaacgggacagacgtagtccgacgttcaactatacgagtagaacgtccgtaggacaggacggacgaggtctagaacttnttacgtcgtacaaacgtgtaacgacgtaaggtagaacgttacgtagtaggttcgggtacggttcggacggtaacgggacgtaacggcgtacggtaccgtaccgtaggtcacggtacccgaggtcctaccggccccgttacgg

SEQ ID NO: 202241 - DNA, 777 bp, Homo sapiens
  misc_feature: GYAE6OF02JTYBQ.21.46.E02.1.454.CMB.1.raw
  modified_base (253)..(253): a, c, t, g, unknown or other
  misc_feature (253)..(253): n is a, c, g, or t
tcagtcgtcgctcgcacgaccggtgctcgatttagactcatctacaggaaaggggtagggtccaggaggcgagaactctgggtgtctcaccatggcctggatccctctacttctcccctcctcactctctgcacaggctctgaggcctccatgagctgacacagccaccctggtgtcagtcgtccccaggacagaccggtccaggactccaccgtgcctctaggccagatgggaccttggaccaaaagaaatntacgacctttaagttcggtaaaccaacgaagaacgccaggaccacggaccccctgtagttacggtatacgtactaagtaaaacgtaccaacgttaggtaacggaccggtaccccgttacaaagggaacgtacgttaccccgtagacggtacctaacgtttccgttcgtacgggtcccaacgttacggcttccgggtaaggaaccgttacgacgtaacgtcgtaacgtttagacgttaacgtacgtaaggttacggaacgtccgaggtacaacggtaacgggacgtagggaccgtagtaaccgttaattaccggttaaggtaaaccgtaaacgtacgttaaacgggtaaccgtaaagggttaaggaaccgggtttaaccttaacgggtaaacggtttcggggttaacgggttccgggttacgggggaacggtaacccgggtaacgtaccggttaacggtacccggtacgttaaggtcccgaccgggtaacccgaacggtaccggttcccggacccccggttacgg

SEQ ID NO: 202242 - DNA, 248 bp, Homo sapiens
  misc_feature: GYAE6OF02ICAZ8.21.46.E02.1.454.CMB.1.raw
  modified_base (242)..(248): a, c, t, g, unknown or other
  misc_feature (242)..(248): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttccctgtctctactgagcgggctggcaaggcgcatagnnnnnnn

SEQ ID NO: 202243 - DNA, 542 bp, Homo sapiens
  misc_feature: GYAE6OF02JD49R.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtgttagtgatatataaagacactgagacggccctcagagatccctgagcgattctctggctccagctcagggacagcagtcacgttgactatcagtgaagtccaggcaggagacgaggctagactattactgacaaacagtagacagtagaggtactactagttgggtagttcgggcggtacgggaccgtaaggccgttacggaacccggttccgtagggtaccgaacggacccgaaggccgttaccggtccccccgttaccggg

SEQ ID NO: 202244 - DNA, 522 bp, Homo sapiens
  misc_feature: GYAE6OF02IG5FW.21.46.E02.1.454.CMB.1.raw
  modified_base (164)..(164): a, c, t, g, unknown or other
  misc_feature (164)..(164): n is a, c, g, or t
  modified_base (322)..(322): a, c, t, g, unknown or other
  misc_feature (322)..(322): n is a, c, g, or t
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagtttttcngacacagcccaccctggtgtcagtcgtccccaggacagacggccaggatccacctgctctgcagatggactgaccaaaagaatatgacttattggtaaccaacagaagccaggccaggcccctgtgttagtgatatataaagacactgagaggccctnagagatccctgagcgattctntggctccagctcgagggacagcagtcacgttnactatcagtgaagtccaggcagaggacgaggctgactattactgtacaacagtagacagtagagtactnagttgggtgttacggcgggaggaccgaagcgtacggaccgttccgtaggtcacggacccgaggctcccggcccctcgg

SEQ ID NO: 202245 - DNA, 583 bp, Homo sapiens
  misc_feature: GYAE6OF02IVU75.21.46.E02.1.454.CMB.1.raw
  modified_base (260)..(260): a, c, t, g, unknown or other
  misc_feature (260)..(260): n is a, c, g, or t
  modified_base (389)..(389): a, c, t, g, unknown or other
  misc_feature (389)..(389): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgcttattggtaccaanagagccaggccaggcccctgtagttagtgattatataaagacaacgtgacgacggccctacgagacgactcccgtagacgcgacttctcgtcggcctccagcgtcgaggacagcagtcacgttgactanacgagtgactcgagacgagaggacgagtactcgacttacttagtgtaacaacgagtaacgaacgagtaagacgttacgtacgtagttcgggtaggttccgggacggggtaacgggtaccgtaacggtccgttaggacccgttaccgtaggtacccgacggacccgaacgggtccctccggtacccccgttccgg

SEQ ID NO: 202246 - DNA, 514 bp, Homo sapiens
  misc_feature: GYAE6OF02GUGXG.21.46.E02.1.454.CMB.1.raw
  modified_base (314)..(314): a, c, t, g, unknown or other
  misc_feature (314)..(314): n is a, c, g, or t
  modified_base (441)..(441): a, c, t, g, unknown or other
  misc_feature (441)..(441): n is a, c, g, or t
  modified_base (487)..(487): a, c, t, g, unknown or other
  misc_feature (487)..(487): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgcttattggtaccaacagaagccaggccaggcccctgtgttagtgatatataaagacactgagacggccctnagagatccctgagcgtattctctgctccgagctcgagggacagcagtcacgttgactatcagtgaagtccaggtcaggaggacgaggctagactattactgtacaaacagtagacagtagagtactntagttgggtgttcggcggtaggaccgagcgtgaccgtcgtaggtcncgacccgaaggctccgccccgtaccgg

SEQ ID NO: 202247 - DNA, 415 bp, Homo sapiens
  misc_feature: GYAE6OF02IEUSQ.21.46.E02.1.454.CMB.1.raw
  modified_base (409)..(415): a, c, t, g, unknown or other
  misc_feature (409)..(415): n is a, c, g, or t
tcagtcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattccgtggggccagggaccctggtaaccgtctcctcagcctccaccaagggcccatcggtcttccccctggcgcccctgcctccaggagcacctccgagagcacagcgcctgggctgcctgtcaaggactacttccgagcgacgactgagcgggctggcaggcgcatagnnnnnnn

SEQ ID NO: 202248 - DNA, 706 bp, Homo sapiens
  misc_feature: GYAE6OF02FZDN6.21.46.E02.1.454.CMB.1.raw
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagacctcctatgagctgacacagccaccctcggtgtcagtcgtccccaggacagacggccaggatcacctgctctgcagatggactgaccaaagaatntgcttattggtaccaanagaagccaggccaggcccctgtgttagtgatataataagacacgtgagacggccctcagagactcccgtagacgcgtatttccgtcgtacggtccctaccgacgtccgtacggaacggggaccaaggacccgtaaggttcccgtaacggtttacgaaccgtttaacgtacgaaggttacggtaaacgtcccggaacgggtacgaaacgggaacgggacggtaacgggcgtaggtaaacttaagttacgttacgtaacctaaaacgtaggtaaacgaacgtaaggttaagaacggttaaccttacgtaaggtttcggggttacgggttaccgggtacggggtaacgggtaaccgtaaaggtcccgttaacgggtaaccccggttacgttaacgggtaccgtaaccggacccggtaacgggtccgtacccggtccccccggttaaccggg

SEQ ID NO: 202249 - DNA, 656 bp, Homo sapiens
  misc_feature: GYAE6OF02FMD3R.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgcttattggtaccaacagaagccaggccaggcccctgtgttagtgatatataaagacactgaggacgtccagagatacctcgagacgacgtacttcgtcgtcgtcctaccgcgtcgtacggacgacgacgacgtacgtaccgtacggttacgtaactagtacgtagtaaggtaaccgtacggacgtaacggagggtaacggacgggtacgtcgaagttaacttagttacgtcgtaaacgaaacgttagaacgtaacgtaaggtaacggtaacgttacgtaaggttacggttagggtttacgggtacggggtacgggtaaccggaccggtaacgtaccggtaccggtaacccggttacggtacggtaccgaccgtaacccggacggtacccgtccccggtacccgttaccccgg

SEQ ID NO: 202250 - DNA, 715 bp, Homo sapiens
  misc_feature: GYAE6OF02I39S2.21.46.E02.1.454.CMB.1.raw
  modified_base (341)..(341): a, c, t, g, unknown or other
  misc_feature (341)..(341): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (395)..(395): a, c, t, g, unknown or other
  misc_feature (395)..(395): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgagcctctatgagctagacacacgcccacccgttggtgtcagttcgaccccgaggaccgagaccggccaggactccaccgtgctcgtgcagagtcggactgacaaaagaatatgtacttagttcggaacaagagaacgccgaggaccgacggtcctgtagtagtgaatagtaataaagacagtagagcgcctagaagntactccgtagagcgtacttcncgtacggcctnacgtctacggacgacaaccgtnacggtactacgttacgaactacttacgaacggtcggtaaacgtccggaacgggtacgaacgggaacgggaggtaccggtacggtaacttaacgttaccgtttaaacgtacgtaaacctaaaggtacggttaacggaacgtaaacggttaaacggacgtttaaacgttacggttacgggtttaacgggtccggggtttaacgggaacggggtaaccggtaacggtaaacggttaccggtaccgggttaaccccgttaccggttaacggacccgtaccggaacccggaaccggttccgtaccccggtcccccggttaaccgg

SEQ ID NO: 202251 - DNA, 607 bp, Homo sapiens
  misc_feature: GYAE6OF02G4ACL.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgtacttattaggtaaccaacgagaacgccacggccacggcccctgtcgttagtgatataataaagacactgagacggccctacgagagactccctgacgcgattctcgtcggcctcagtctacgagggacagcagtcagttgactactcgagtagaacgtccgaggacgtaggacggacggaggctacggacttagttaacgtcgtaacaaacgtaacgtaagaacgtaaggtaaggtaacgttacgtacgtagttcgggttacggttcgggacgggtaacgggacgaaacggtcctacgggacccgttaccggttaacggtcggaccgtaccgtacggaacggtccgtacccgtacccccggg

SEQ ID NO: 202252 - DNA, 618 bp, Homo sapiens
  misc_feature: GYAE6OF02ITX9R.21.46.E02.1.454.CMB.1.raw
  modified_base (184)..(184): a, c, t, g, unknown or other
  misc_feature (184)..(184): n is a, c, g, or t
  modified_base (255)..(255): a, c, t, g, unknown or other
  misc_feature (255)..(255): n is a, c, g, or t
tcagtcgtcgctcgcacgaccggtgctcgatttagactcatctacagggaaagggggtggggtccaggaggcagaactctggggtgtctcaaccatggcctggatccctctacttctccccctccttcactctctgcacaggctctggaggcctccgtatgagctgacacagccaccctgggtntcagtgtccccaggtacagacggccagggactccacctgctctgccagatggacctgaccaaagtaaactntgacttaatggtaccaaacagaacgccaggccacggccctgtgtagtgatatataaagactacgtgagacggtcccttacgagacgtactcccgtagagccgtacttctcgtggtacctccgacgcttacgacgggtacaggtcaggttctacgtgactatacagtcgaacgtcgaggcaggacggtacgagtcgtagacttagttacagtacaaacgtagtacgaactaagtaagtacgttactctaaggtttcgggtcgtacgggtacgggtaacggaaccggtaaggtccgtaggtaacccgttaccgttaaggtacccgaacgaccccggtaaggcccgttacccggccccgttaccgg

SEQ ID NO: 202253 - DNA, 587 bp, Homo sapiens
  misc_feature: GYAE6OF02FQUHF.21.46.E02.1.454.CMB.1.raw
tcagtcgtcgctcgcacgaccggtgctcgattagactcatctacagggaaaggggttgggtccaggaggcagaactctggtgtctcaccatggcctggatccctctacttctccccctcctcactctctgcacaggctctgaggcctcctatgagctgaccacagcccaccctcggtgtccagtcgtcccccaggaccagaccggccaggactccaccctgcctctgccagatcggacctgacccaaagaactatcgcttatggtaacccacacgacgcccaggccaggccccctgtgttactgatatataaacgacactgacgacggccctacagacgactccccgtgacggtcctacttctacgtcggcctaccgagcctcgacgggacacgcacgtcacgttgaactctcgagtgaacgtccgaggcgagacggaccgaggtctacgtactacttactcgtaccaaaactagtaacgactaagtacggaagttactctaggttggtcgtacggcgacggaccgaagtccgtacgtaccgtccgtaggtaccgacgtacccgacggccctccgtcccccgtccgg

SEQ ID NO: 202254 - DNA, 553 bp, Homo sapiens
  misc_feature: GYAE6OF02FNXO5.21.46.E02.1.454.CMB.1.raw
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtgtcagtcgtccccaggacagaccggcaggatcacctgctctgcagatggactgaccaaaagaatatgacttattggtaccaacagaagccaggccaggcccctgtgttagtgatatataaagacatgagaggccctanagagactccctgacgcgattctcgtcggctccgagctacgagggaacagcagtcctacgttagactatacgagtagaacgtccgaggcaggaggacgaggctagtactacttacgtgtacaaacgtagagacgagtaggagttaccagtagtttgggtgttccgggacggagggacctaaggcgtacgacccgttcgacggtcacggacccgtaaggcctccggtcccccgtacgg

SEQ ID NO: 202255 - DNA, 506 bp, Homo sapiens
  misc_feature: GYAE6OF02FK90X.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaagccaggccccctgtgttagtgatatataaagacactgagaggccctcagagatccctgagcgattctctggctccagctcagggacagcagtcacgttgactatcagtgaagtccaggcagaggacgaggctgactattactgtacaaacgagtagacagtagagtactcagttgggtgttcggcggagggacaaggctaggaccgtccgtaggtcacggcccaaggctcgccccctcgg

SEQ ID NO: 202256 - DNA, 548 bp, Homo sapiens
  misc_feature: GYAE6OF02I1O8I.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggaccagacggccaggatccacctgctctgcagatggactgaccaaaagaaatatgcttattaggtaccaacagaagccaggccacggcccctgtgttagtgatatataaagacactgagacggccctcgagagactcctgacgcgtattctcgtcggcctccgagctacgacgggacaggcgacgtccgtacgttcgactagtcgagtagacgtccgaggcaggacggacgaggctgacttattactagtacaacagtagacgagtagagtactgtagttgggtgttcggacggacggacgtaggcgtacggaccgttcgtacggtcacggcccgacggtcctccgtcccctacgg

SEQ ID NO: 202257 - DNA, 541 bp, Homo sapiens
  misc_feature: GYAE6OF02IOB3V.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaggatcacctgctctgcagatggactgaccaaagaatntgacttattggtaaccaacagaacgccaggccaggcccctgtgttagtgatatataaagacactgagacggcctacagagactccctagagcgacttctcgtggctccagctacgaggacagcagtcgtacgttgactactacagtagaacgtccgagacaggacggacgaggctagacttattactcgtacaaagagtagacgagtaagagtactacgtagttgggtgttcgggacggagggtaccgaagtcgtacgtaccgtccgtagtcgacgaccgacggcctccggccctccgg

SEQ ID NO: 202258 - DNA, 671 bp, Homo sapiens
  misc_feature: GYAE6OF02IRGWU.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccacccgtcggtgtcagtcgtccccaggacagacggccaggatccacctgctctgcagatggactcgaaccaaaagtaaatntcgtactttattcggtaaccaacagaacgccaggccaggcccctgtgttagtgatataagtaaagacactgagacggccctagagagactccctaggacgtcgacttctccgtggtccttccgagtccgtacggaacggggtaccacggtcctaggttacctacggtttacgaacttagtactaaggttacgaacggttccgaggacgagggacggacggacggtctagtacttacttacgtacgtaacctaaagtacggtaaagtacgtaaagtacggtaacggttaacgtcgttaacggttcggggttacggttcggggacgggtaacgggtaccgtaaggttccggtaacccggttcgtacgggtaacaccggtacccggtaacggtcccgtcccggtcccccgttaggttaccccgg

SEQ ID NO: 202259 - DNA, 594 bp, Homo sapiens
  misc_feature: GYAE6OF02IBKY6.21.46.E02.1.454.CMB.1.raw
  modified_base (327)..(327): a, c, t, g, unknown or other
  misc_feature (327)..(327): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagagtggactgaccaaaagaaatatgtacttattacggtaccaaacagaagccgaggccaggcccctgtcgttagtgataataataaagacacgtgagacgccctnagagtactccctgagcgattctctggctccagctcgagggacagacgagtctacgttagactatcgagtagaacgtcctaagtgactaggaacggacgacggtctagaccttaagttactagtaacaaacgagtacgaactaaggtaagaggtactcgtaagttggggttcgtcgggtacgggacggtaaccgtaagtccgtacggtaacccgtccgttaacgggcctaaccggaccccgtaaggtcccgtacccggtaccccccgg

SEQ ID NO: 202260 - DNA, 726 bp, Homo sapiens
  misc_feature: GYAE6OF02HIXGD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatggagctgacacagccacctcggtgtcagtcgtcccaggacacgacggccaggactcaccgtgctctgcagatggactgaaccaaagaaatatgtactttagttacggtaaccaacaagaacgccgaacggccgacggcccctggttcgttaagtagtaataataataaaagactaacgtgacggacggccctagaaggaacgacgtcccgtaggaacgtcgtaatttccgtcgtcggacctcgaacggcctacggaacgggactacggactaacggtctaacggtttacgaacgttaactccgaagttaggtaacggttaccgaagggacgaaagggaacgggacggacggttacgtaacggtaactttaacgttacgtacgttaaacgaaacgtaagtaacggtaacgtaaggttaacggtacggttaactacggttaaggtttacggggtcgggttaacggggcgggaacgggacccgttaaaggacccggttaggaacccggttaccgtaaggggttaccctacgggaccccggtaacgggtccccgttccccgggtaccccgttcggg

SEQ ID NO: 202261 - DNA, 651 bp, Homo sapiens
  misc_feature: GYAE6OF02JEHTC.21.46.E02.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccgaggacaggacggccaaggatccacctgctctgcagatggactgaccaaaagaatntgactttagtcggtaaccaacagaacgcacggccacggccctgtagttagcgtataatataaagacacgtagacgacggacctacgagacgactcccgtagacgtcgtaattcgtcgtggtacctccgaacgtctacgaacggacacgacgacgtacacgttagacttactacgaagtcgaagtaccgaggacaaggtaggacgaggtactacgtactaagttacgtacgtaacctaaagtacgtaagtaacgtaacggtaagtaacggttaacctaggttaggtttcggggttaacgtaccgggtagggtaaccggtaaccggtaacggcctaacgggtaaccgttaccgttaaggaccgtacggaccccgtaacgggtccttacccgggtccccgttaccggg

SEQ ID NO: 202262 - DNA, 643 bp, Homo sapiens
  misc_feature: GYAE6OF02H5JIR.21.46.E02.1.454.CMB.1.raw
  modified_base (248)..(248): a, c, t, g, unknown or other
  misc_feature (248)..(248): n is a, c, g, or t
tcagtcgtcgctcgcacgaccggtgctcgatttagactcatctacagggaaagggggtgggtccaggaggcagaactctgggtgtctcaccatggcccggatccctctacttctccccctcctcactctctgcacaggctctgaggcctcctatgagctgacacagccaccctcggtgtcagtgtcccccagggaccaggaccggccaggatcacctgcctctgcagatggactgaccaaaagaaatntgcttattggtaccaacagaacgccaaggccacggcccctgtgttagtgatataataaagacactgagacggccctagagagactccctgacgcgtattcctcgtcggccttaccgagtcctacggaacgggacacgcgtacgtcgacggtttacgacttactacgagttagaacggtccgaaggacgaggaacgggacggaggactagtaacttattacgagtacaaacgtagtaagacgtaggtaacgaacggttacttacgtaggttacgggttacgttccggggaacgggacgggtaaccgaaggtccgttaccggtacccggttacgtaacggttaccgacggtaccccgacggttcccggtaccggtccccccggttacggttaccccg

SEQ ID NO: 202263 - DNA, 248 bp, Homo sapiens
  misc_feature: GYAE6OF02F0D5C.21.46.E02.1.454.CMB.1.raw
  modified_base (243)..(248): a, c, t, g, unknown or other
  misc_feature (243)..(248): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggagcacctccgagagcacagcggccctgggctgcctggtcaaggactacttcccgagcgacgactgagcgggctggcaaggcgcatagnnnnnn

SEQ ID NO: 202264 - DNA, 708 bp, Homo sapiens
  misc_feature: GYAE6OF02H21QU.21.46.E02.1.454.CMB.1.raw
  modified_base (359)..(359): a, c, t, g, unknown or other
  misc_feature (359)..(359): n is a, c, g, or t
tcagtcgtcgctcgcacgaccggtgctcgatttagactcatctacagggaaagggggtgggtccgaggaggcagaactctgggtgtctcaccatggcctggatccctctacttcctccccctcctcactctctgcacaggctctgaggcctcctatgagctgacacagcccacccgtcggtgtcagtcgtccccaggacacggacggccaaggatccacctgctctagccagatggactcgaaccaaaagaaatatgactttagttacggtaccaaacaaggaacgaccgacggccgacggtcccccttggtagtttaagtgaattaataataaaacgactacgtgaagacggccctanaaggacgtaactcccgtagacgtacgtaactttccgtacgtgggcctacccaggtcctacgacgggaacaacggctagtaccgtacggtttacaacttactacgtaacgttagaacgtaccggaggacgaaggacggaaggtacggcttaggtaacttaacgttacgtacgtaaaccgtaaacgtaacggtaacgtacgtaaggtaaaggtacggttaaaccctggttaaacggtttggggttacgttcggggaccgggaagggtaacccaaggtaccgtacggtaacccgttacgtacggtacgacccggaacccggtaacggtcccgtacccggtccccgttaccgg

SEQ ID NO: 202265 - DNA, 650 bp, Homo sapiens
  misc_feature: GYAE6OF02I3MWM.21.46.E02.1.454.CMB.1.raw
  modified_base (272)..(272): a, c, t, g, unknown or other
  misc_feature (272)..(272): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggccctcctatgagctgacacagcccaccctcggtgtcagtcgtccccaggaccagaccggccaggactccacctgctctgcagagtggacctgaccaaaagaaatatgcttagttacggaaccaanagaacgccacggccgacggtcccctgtcgttagtagtataataataaagacacgtggaggacgcccctagagacgtactcccgtaggacgcgtactttctcgtacggcctaccgagacgtacgaacgggaccaggccacgtccgtacgttacgacttactacgaggtacggaacgtccgagcgaaggaggacgaggtcgtagacttagttactacgtaacaaacgtgtaagaacgtaagtaacggtaacgtaccttacgtaggtttcgggtacgggtaccgggtacgggtaacggtaaccgaaggttacccgtacggtacccggtacgttacggtacgaccggtaccccgaggtcccgtcccgtccccggttacccgg

SEQ ID NO: 202266 - DNA, 560 bp, Homo sapiens
  misc_feature: GYAE6OF02JA4L2.21.46.E02.1.454.CMB.1.raw
  modified_base (436)..(436): a, c, t, g, unknown or other
  misc_feature (436)..(436): n is a, c, g, or t
  modified_base (453)..(453): a, c, t, g, unknown or other
  misc_feature (453)..(453): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaatatgcttattggtaccaacagaagccaggccaggcccctgtcgttagtgatatataaagacacgtgacgaggccctacagagactccctagagcgtatctctggctcagctcgaggcagcgagtctacgtcgactatcgagtcgaagtccaggcaagacggacgaggctaggactaattctcgactaaacgagtacganacgtaaggacgttaacncgagtttgggtcgttcggagggtaacggaacgtaacggtcgtaaccggtacccgtaccgtaggttacccgaggaccccgaagggtccgtaccggtcccccgtacggg

SEQ ID NO: 202267 - DNA, 740 bp, Homo sapiens
  misc_feature: GYAE6OF02J0VT2.21.46.E02.1.454.CMB.1.raw
  modified_base (389)..(389): a, c, t, g, unknown or other
  misc_feature (389)..(389): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtacagtcgtccccaggacagacggccaggctcacctgcctctacgcaagatcggactcgaccaaaagaatatgacctttattcggtaaccaacgagaacgccgaggccgaacggccccttgttaggttagagtaactaattaacgaaaacgtacaacgttggaaggacggcccctagaaggacgtacttccccgaggacgccgtaatttcncgtaggtcctaccgagtcctacggacggggacagccgtaacggtctaccggttagaacgttagtacgtaagtacggtaaacgttccggaaaggaccggaaaggtcggaaccggtaggtaaccgttagtaacgtttaacgttacgtacgtaacctaaaacggtacgttaagtaaccgtaaggtaacggtaacggtttaacgttaccgttaaaggtttcggggttaacgggttaccggggtacgggtaaccgggtaaccgtaacgggaccgttaccgggtaacccgttaacggttaacggtaccgtaaccggaaccccgtaacgggccgttaccccggaccccggttacccgg

SEQ ID NO: 202268 - DNA, 622 bp, Homo sapiens
  misc_feature: GYAE6OF02F1D1A.21.46.E02.1.454.CMB.1.raw
  modified_base (291)..(291): a, c, t, g, unknown or other
  misc_feature (291)..(291): n is a, c, g, or t
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccgaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgtcttatggtaccaacgagaagccaggccaggcccctgtgttagngatatagtaaagacactgagaggtcccanagagactcccgtagacgcgtattctactcggacctccgacgtcgtacgaacggtaccaagtccgagttccaacgttagtaacttagtacgtacgtacgaacggttccgaaggacgtacggaagggaccgtaggtaccgtagtaacttacttaacgtacgtaacaaacgtacgtaagaccgtaggttaaagacggttactacgtaggttggtacggttcgggacgggtacggacgaaacgtgtacggacccgttcggttaacggacgacgtaacccgaggtccgtaccgtaccccggtaccgg

SEQ ID NO: 202269 - DNA, 667 bp, Homo sapiens
  misc_feature: GYAE6OF02HTIND.21.46.E02.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgacttattacggtaccaaacagaagaccacggccacggcccctgtgttagtagatataataaagacactagagacggccctnagagactccctagacgacgtattctctggcctaccgagctacggaggtaacgagacctaggtactacggttacgtacttaagtacgtaaggtagaaacggtccgaaggcgaaggacggaacggtacggcgttaacggtaactttaactaacgtctaaacgaaacgtaagtaacgaacgtaaggttaagtacggttaaccgttagtacggttaggggttacggtacggggacgggaaccgggtaaccgaacggtccggttaacggtaacccgttaccggttaacggtaccggaaccggtaccccgggaaccggtacccgtacccccggtcccccgtttaccggg

SEQ ID NO: 202270 - DNA, 620 bp, Homo sapiens
  misc_feature: GYAE6OF02HCSLD.21.46.E02.1.454.CMB.1.raw
  modified_base (239)..(239): a, c, t, g, unknown or other
  misc_feature (239)..(239): n is a, c, g, or t
  modified_base (318)..(318): a, c, t, g, unknown or other
  misc_feature (318)..(318): n is a, c, g, or t
  modified_base (382)..(382): a, c, t, g, unknown or other
  misc_feature (382)..(382): n is a, c, g, or t
  modified_base (412)..(412): a, c, t, g, unknown or other
  misc_feature (412)..(412): n is a, c, g, or t
tcagtcgtcgctcgcacgaccggtgctcgatttagactcatctacagggaaagggggtgggtccgaggaggcagaactctgggtgtctcaccatggcctggatccctctacttctcccctcctcactctctgcacaggctctgagcctcctatgagctgacacagccaccctggtgtcagtcgtcccaggacaggacggcaggatcactgctctgcagatggactgaccaaaagaaatngtctttaagtggtaaccaaacagaagaccaggcctaggcccctggtagttacggtagactagtaataaaacgactaacngaagacggccctagaagacgactccgtagagtacgtattcgcgtcgactcaagctagaggacancgtaagtcgacgttgaactagtactggtanaaacgtccgagtaccgagaagggacgagggacctacgtaacgttaattacgttagaaccgtaaaacgaagtaacgtaacgaacggttaaggaacgttaacacggttaagttacgggttgggtcgggacgggtaacggacggttaaacgcggtacgtacccggtacgaggtaccgtaacgaccggtaacgtcgtcccgccccggtacgg

SEQ ID NO: 202271 - DNA, 577 bp, Homo sapiens
  misc_feature: GYAE6OF02FGJE1.21.46.E02.1.454.CMB.1.raw
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
  modified_base (408)..(408): a, c, t, g, unknown or other
  misc_feature (408)..(408): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgcctcngcagatggactgaccaaagaaatatgacttatggtaaccaanagtaagccaggccaggcccctgtgttagtgatatataaaagacatgagaggccctcagagactccctgacgcgtattctcgtaggcctccgagcctcgagggacagcagtcacgttgactatcagtgaacgtccaggcagaggacgnggctagacttattactgtacaaacgtagtacgacgtagtaagtaacggttactacgtagtttgggtacgttcggggacgggaacgggaccgaaggccgtaccggtaacccggttccgtaacggtccgacggtaccccgaacggtcccgttaccggccccccgttaccgg

SEQ ID NO: 202272 - DNA, 560 bp, Homo sapiens
  misc_feature: GYAE6OF02GEHLN.21.46.E02.1.454.CMB.1.raw
  modified_base (335)..(335): a, c, t, g, unknown or other
  misc_feature (335)..(335): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (540)..(540): a, c, t, g, unknown or other
  misc_feature (540)..(540): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagagtggactgaccaaaagaaatatgtacttattcggtaaccaaacaagaaacgccaggcccacggtcccctgtcgttagtgatataagtaaagacactaggagacggccctanaagagactccctgacgacgtacttcctcgtggcctaccgagctacggaacgggacacggcacgtccgtaagttcgaacttatcgaagtagaacgtccgagggtacagggacggacgaggctagacttagtcgtagaacaagagtagacgtaagtacgagtactgtagttgggtgtacggngaggacngntacgaccgtgtacganacgccgagcctcgccctcgg

SEQ ID NO: 202273 - DNA, 552 bp, Homo sapiens
  misc_feature: GYAE6OF02I3SZW.21.46.E02.1.454.CMB.1.raw
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
  modified_base (444)..(444): a, c, t, g, unknown or other
  misc_feature (444)..(444): n is a, c, g, or t
  modified_base (498)..(498): a, c, t, g, unknown or other
  misc_feature (498)..(498): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgcttattgtaaccaacagaagccagccaggcccctgtgtagtgatataataagacactgagacggccctnagagactcctagagcgtattctcgtagcctaccagctcagggacagcagtcctaacgttgactaactnaagtacgtaagtcgaggacaggaggacgaggctagactatacgtagtaacaactaggtaanacgtagtaagtacgtactacgtaggtttacgggtgttcgggacggaggaaccgnggtaccgcgtaaccgtccgtaggccacggaccaaggtcctccggtcccctacgg

SEQ ID NO: 202274 - DNA, 806 bp, Homo sapiens
  misc_feature: GYAE6OF02JZ59I.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctctatgagctgacacagcctaccctcggtgtcagtctccccaggacagacggccaggactcacctgctctgcagatcggactcgaaccaaaagtaaattangtcttagttacggtaaccaacgaaggaacgaccgaacggcccgtaaccggtcccccgttaggttacggtttaacggttacggtaacttaagttaaaacgttaaaacggaacctaaccgttaggaaacgggtacccggtaccccgttaacgaaaggaacggttaccgtttaccccgaaggacggtaaccggtacgtttccgttaccggtcggtacccgttcccgaacggtaccgttaccgggaacggggtaacccgaacggaccgtaacggttacccggtaacggtttacggtaaccgtttacgtaccgtaaggttacggtaaaacgttcccgaacgggtaccgaaaggggtaaccgggacggtaacggtacgttacgtaaacgtttacgttaacgttaggtaaccaaaagtagtaaaccgacgtaaggtaacggttacgttaaccgtgttaaacggttggggttacggttaccgggagggtacggtaacccgaaggtccttaacggtcccgtacggtacggtcgaacgtaccgaacggtcctaccgtccccgttaacgg

SEQ ID NO: 202275 - DNA, 526 bp, Homo sapiens
  misc_feature: GYAE6OF02HJ4Q3.21.46.E02.1.454.CMB.1.raw
  modified_base (241)..(241): a, c, t, g, unknown or other
  misc_feature (241)..(241): n is a, c, g, or t
  modified_base (314)..(314): a, c, t, g, unknown or other
  misc_feature (314)..(314): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (475)..(475): a, c, t, g, unknown or other
  misc_feature (475)..(475): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtgttagtgatataataaagacactgagaggccctnagagactccctgagcgtattctcgtggcctccagctcgagggacagcagtctacgttgacttatcagtcgaagtccaggcaaggaggacgaggctgacttatacntacaaanagtanagagtagagtactgagttgggtgttggcgggaaggaccgtaagngtacggacccgttacgaggtcacggcccgaaggtcctaccggccccgtcgg

SEQ ID NO: 202276 - DNA, 653 bp, Homo sapiens
  misc_feature: GYAE6OF02HM2IP.21.46.E02.1.454.CMB.1.raw
  modified_base (252)..(252): a, c, t, g, unknown or other
  misc_feature (252)..(252): n is a, c, g, or t
  modified_base (371)..(371): a, c, t, g, unknown or other
  misc_feature (371)..(371): n is a, c, g, or t
tcagtcgtcgctcgcacgaccggtgctcgatttagactcatctacagggaaagggggtggggtccgaggaggcgagaactctgggtgtctcaccatggcctggatccctctacttctccccctcctcactctctgcacaggctctgaggcctcctatgagctgacacagtcccacccgtcggtgtcagtcgtccccaggacacgacggccaggactcacctgctctgcagatgggactgaccaaaagaaatntgtacttaagttcggtaaccaaacgaagacgaccacggccacggcccctaggtgtagtagataataataagactactaggacgacgtccctgaagtagactccgtagagtcgatttccncgtcggtactccgaagtctaccgagggaacacgcgtacttacggacttacgtactagtacaggtagacgtacgaaggcgaaggtaaggacggacggcgtacggtacttagttaactagtaacaaacgtacggttaaagaccgtaagtaacggtaacggttaacttcggtaaaggttcgggttagtttaccggggacggggtacggtaaccggaacggtcgtaaccggaccggttacgtacggttacggacgaccggtaacggctacccggtcccgtacccgg

SEQ ID NO: 202277 - DNA, 760 bp, Homo sapiens
  misc_feature: GYAE6OF02FXRI4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatcgctttagttaggtaaccaacaagaagccaggccacggcccctgtgttagtgtaatataataagacactagagacggccctcgaagtacgactccccgtagacgacgtattcgtacgtcggccttaccgagtacctacgacggggaacctaggaccgtacgtaccgtaacgtttacgtaccgttaactcgtaaggtagtaaacggtcccgaagggaccaagggaaccgggaacgggaggtacctagtaaacgtttaacgttaacgtacggtaaccgtaaaacgtaaggttaacggaaaccgtaaagggttaaacggttaaccggttaaccgttaaccggtaaaggttttacgggggtttaccggttaccggggtaaccgggggtaaccggggtaaccctaaacgggtaccggttaaacccgggtaaccccggtttacccgggtaaccgggtaccgtaaccccgggaccccggtaaacgggtccccggttacccccggttacccccggttaccccggg

SEQ ID NO: 202278 - DNA, 883 bp, Homo sapiens
  misc_feature: GYAE6OF02IURON.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagatcggactgaccaaaagaaactagtgactttaattgggtaacctaacaagaaacgcccgaagggtaccccacgggtccccccttaggttacggtttaacggttaggtaattaacgttaaaagttaaaaacggaaccgtaaccggttaacgggaaacgggtaaccgggtacccccttaacggaaacggtaacggtaaccgttacccccggttaaggtaacgggtacccgttaaacgttttcccgttaccggtttccgggtaccctacccggtaacggtccgttaaccgggtaaacggggaaaccgtacggtaccgtaacggttacccgttaaccggtttacggttaaccgttaacgtaccgtaacgggttaacggtaaaccgttacccggaaagggtaccgtaaacggggaacgggtaaccgggtaacgggtacgttacggtaaaccgtttaacgtttaacgttaaccgtaaaccgtaaacgtaacggtaaacgaaccgtaaggtaaacggttaacggttaacgttacgttagggtttacggggttacgggttaccgggacggggtaacgggtaaccgaaggttccgtaccgggtaacccgttacggtaacggtaccgaccggaacccgtacggtcccgtacccggtaccccggtaccgg

SEQ ID NO: 202279 - DNA, 575 bp, Homo sapiens
  misc_feature: GYAE6OF02F8B77.21.46.E02.1.454.CMB.1.raw
  modified_base (268)..(268): a, c, t, g, unknown or other
  misc_feature (268)..(268): n is a, c, g, or t
  modified_base (297)..(297): a, c, t, g, unknown or other
  misc_feature (297)..(297): n is a, c, g, or t
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccctcggtgtcagtcgtccccaggacagacggccaggatcacctgctctgcagatggactgaccaaaagaaatatgcttattggtaaccaagagaanccgaggccaggcccctgttgtagtgatanataaaagacactgagagccctanagagatcccgtgagcgtacttctcgtggcctccagctcgaagggacagcagtccacgttgactatcgaagtgaagtcaggcaaggaggacggagctagacttatacgtagtaaccaaagtagtaagacgagttaaggacgttacgataggtttcgggtgttacgggagggtaacggaaccgtaaggtccgtacggaaccccggttcgtaaccggtcaaccggtacccgaaggcccgttcccgacccccgttccgg

SEQ ID NO: 202280 - DNA, 699 bp, Homo sapiens
  misc_feature: GYAE6OF02IY62C.21.46.E02.1.454.CMB.1.raw
  modified_base (263)..(263): a, c, t, g, unknown or other
  misc_feature (263)..(263): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgctttattcggtaaccaanagaacgccaggccacggccctgtgttagtgatatataaagacactgagacggccctagaganactccctgacgcgtatttcctcgtcggcctccgagtcctacggaaggggaccacggaccaggttccgaacgtttcgaacttaacgtacgtaacggttacggaacggtaccgaacgggacgaagggaacgggacggaacggtcgtacgtaacgttagttacgtacggtaaccaaaacgtaagtaacgacgtaaggttaacggtaacggttaacgttaccggtaagggtttcgggttacgggttaccggggtaccggggtaacgggtaacccgtaacgggtccgttacgggtaaccccggttaccggttaaccgggtaccgaaccggtacccccggtaacgggacccgttaccccggacccccccggtttaccggg

SEQ ID NO: 202281 - DNA, 806 bp, Homo sapiens
  misc_feature: GYAE6OF02IYXQA.21.46.E02.1.454.CMB.1.raw
  modified_base (181)..(181): a, c, t, g, unknown or other
  misc_feature (181)..(181): n is a, c, g, or t
  modified_base (212)..(212): a, c, t, g, unknown or other
  misc_feature (212)..(212): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtntcagtcgtccccgaggacagaccggccaggntccacctgctctgcagagtaggactgaaccaaaagtaaatagtgtactttagttacggtaaccaaacgagtaacgaccgaacggacccgaacggtcccccgttggttaggttacggttagtaattaaattaagtaaaacggacctaacgttacggaacggaaccgggtaccccttacggaaggtaacggtaactaccccgtaggaacgtccggttaactttccgttccggttacggtacccttccgaaggtcccgttacggaacggggtaccacggccgtaacggttaccgttaaccggtttagtaaccttacgtacgtaagggtacggtaacgttacccggaaggggtacccgaagggaacggggaacggtacgggttactaacggttaacgttaacgttacgtacgtaaccgaaaagtacggtaataacgtaaggttaacggtaaggtacgttacgtaagggtttagggttacgggtacggggacgggtaacgggtaaccgtaacgggtccgtacgggtaaccccggttaccggtacggtaccggtaacggaccccgtaaccgggtccgtaccccggtaccccggttaccgg

SEQ ID NO: 202282 - DNA, 524 bp, Homo sapiens
  misc_feature: GYAE6OF02HECLM.21.46.E02.1.454.CMB.1.raw
  modified_base (473)..(473): a, c, t, g, unknown or other
  misc_feature (473)..(473): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgacttattggtaccaacagaagccagccaggcccctgtgttagtgatatataaagacactgagaggccctgagagactccccgtagacgcgtattctctggcctccagtctacgagggacagcagtcacgttgactatcagtagaacgtccgaggcaggaggacgaggctagactattacgtagtacaaacgtagtaagacagtagagtactgtagttgggtgttcgggnggacgggacaggcgtggaccgtcgtaggtcacgccaaggctccgcccgtcg

SEQ ID NO: 202283 - DNA, 644 bp, Homo sapiens
  misc_feature: GYAE6OF02IQ6I1.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttatggtaaccaacagaagccaggccaggccccctgtgttagtagatataataaagactactgagacggccctacagagactcccgtagagcgaattcctcgtggcctaccgagccgtacgacgggacacgcagtccgtaacgttcgaacttatccgagtacggtaaagtcccgaagggtacaagggtacggaacggaggtctaggtaaccttaattacgtacgtaacaaacgtagttaacgaacgaaggttaaggtaaggttaacctacggtacggtttagggggttcggtttaccggggacgggtaacggggacctaaacggtcgtaacgggtacccgttacggtaacggtacgaccggtacccggaacggtcccgttacccggcccccgttacccgg

SEQ ID NO: 202284 - DNA, 618 bp, Homo sapiens
  misc_feature: GYAE6OF02JFSNK.21.46.E02.1.454.CMB.1.raw
  modified_base (444)..(444): a, c, t, g, unknown or other
  misc_feature (444)..(444): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacatacggccaggatcacctgctctagcagatggactgaccaaagaaatatgtcttattcggtaccaacagaagccaggccaggcccctgtcgtagtgatatataaacgacactgagaggccctacgagacgactcccgtagagcgtattcctactcgggccttaccgagtcctacgtaggggacacggccagttaccgacgttagacttactacgtagtacggaagtccgaggacgaggacggacggaggngtacgtacttaacttacgtagtaacctaaacgaacgtacgaacgtaggtaagtacggtacttacgtagttcggggtggtttaccgggacgggtacggaaccgaacggtccgtacggacccgttacgtacggtacgacggtacccgacgggtaccgttaccggccccttaccggg

SEQ ID NO: 202285 - DNA, 736 bp, Homo sapiens
  misc_feature: GYAE6OF02FWFI7.21.46.E02.1.454.CMB.1.raw
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagaccggccaggatcacctgcctctgcagntggactgaccaaagaatatgcttatggtaaccaanagaacgccgagccaggcccctgtcgttagtcatataataagacactgagacggccctacagagactccctagacgcgtacttctcgtacggtcctccgtagcctcggaacggggaccacggaccgtaggttaccgtaacggtttacggtaaccttagttacgtaggttacggtaaacggttacccgaagggtaccaaaggggtaacggggaaccggtaacgggtaccgttacgggaaacctttaacgttacgttacgggttaaccaaaacggtaacggttaacggaaccgtaaggttaacggtacggttaaccgttaacgttaacgggtttaggggttacggttaccggggtaccggggtaacgggtaacccggtaaacggttaccgttacccgggtaacccggtttaccgttaacgggtacccgtaacccggacccggtaacgggtcccgttaccccggtcccccggttacccggg

SEQ ID NO: 202286 - DNA, 526 bp, Homo sapiens
  misc_feature: GYAE6OF02FL5NN.21.46.E02.1.454.CMB.1.raw
  modified_base (289)..(289): a, c, t, g, unknown or other
  misc_feature (289)..(289): n is a, c, g, or t
  modified_base (317)..(317): a, c, t, g, unknown or other
  misc_feature (317)..(317): n is a, c, g, or t
  modified_base (339)..(339): a, c, t, g, unknown or other
  misc_feature (339)..(339): n is a, c, g, or t
  modified_base (445)..(445): a, c, t, g, unknown or other
  misc_feature (445)..(445): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggccccctagtgttagngatatataaagacactgagacggccctnagagactccctagagcgattcnctggctccagctcgagggacagcagtccagttgactatcagtgagtccgagcaggaggacgaggctagactattactgtacaaacgagtagactagtaagagtacncgtagttgggtcgtgggcggacggacctaaggccgtacgaccgtcgtaggtcacgacccgaaggcctccggcccccgtcgg

SEQ ID NO: 202287 - DNA, 812 bp, Homo sapiens
  misc_feature: GYAE6OF02HLK5S.21.46.E02.1.454.CMB.1.raw
  modified_base (183)..(183): a, c, t, g, unknown or other
  misc_feature (183)..(183): n is a, c, g, or t
  modified_base (289)..(289): a, c, t, g, unknown or other
  misc_feature (289)..(289): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacggcctcctatgagctgacacacgcccacccgttggtntcagttccgtccccgaggacacggcggaccaggactccaccgtgctcgtgacgagtagtggactacgaacaaaagtaatgtcgtactttagttacggtaaccaaanaagaacgaccgacggacccgacggtcccccgttggtacgtttaaggtacgtaagttaattaaagtaaaacggaaccacgtaggaacggaccggtaccctacgacgtaagtacctccccgtaggacgtacgtactttccgtcgtcggtcctaccgacgtcgtacggacgggaaccaggacctaacgtaccgtacggttacaaccgtttacacggtaggttagtaaaccggttccgaagggtacgaaggggaacggtacgggtacggacgttacgaacgtttacgtttacgtacgtaaaccgaaagtacggttaaacgaccggtaaagggttaacgggtaaaccggttacgttaaccggttaagggtttcggggttacggggttaccggggaccggggtaaaccggggtacccgtaaacgggtccgttaaccgggtaacccggttacccgggtttaacggacccggtaacccggaacccggtaaccgggtacccgttcccccgggtaccccccggtttacccggg

SEQ ID NO: 202288 - DNA, 534 bp, Homo sapiens
  misc_feature: GYAE6OF02F8OJV.21.46.E02.1.454.CMB.1.raw
  modified_base (317)..(317): a, c, t, g, unknown or other
  misc_feature (317)..(317): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattaggtaccaacagaagccaggccaggccccctgtgttagtgatataataaagacactgagaggccctnagagatccctgagcgattctctggctccagctcaggacagcagtcaagttgactatcagtagaagtccgaggcaagacggacgaggntgactattacgtntacaaanagtaagacagtagaggtactcgagtttggtgttacggacggagggaaccaacggtcgtacggacccgtacgtaggtcgaacgtcccgaaggcgtaccgccccgtaccggg

SEQ ID NO: 202289 - DNA, 798 bp, Homo sapiens
  misc_feature: GYAE6OF02I1NU1.21.46.E02.1.454.CMB.1.raw
  modified_base (162)..(162): a, c, t, g, unknown or other
  misc_feature (162)..(162): n is a, c, g, or t
  modified_base (176)..(176): a, c, t, g, unknown or other
  misc_feature (176)..(176): n is a, c, g, or t
tcagtcgtcgctcgcacgaccggtgctcgatttagactcatctacaggggaaggggtgggtccagggaggcagaactctgggtgtctcaccatggcctggatcctctacttctccccctcctcactctctgcacaggctctgaggcctcctatgagctgacncagccaccctggtntcagtcgtcccaggacagacggccaggatcactgctctgcagatggactagaccaaaagtaaatatcggtactttaaggttcggtaaccaaacgaggaaacggacctaacgggccccgaacgggtcccccgttaggttacggtttacggtaggtaacgttaactaaacgttaaaacggaacctaaccgttagggaacggtacccgggtacccttacgaaacgaacggtacctaccccgttaggaacggtaccgtaacttttcccggtacgtaccgggtcccttacccggtacgtccggttaaccgaacggggggtaacccaacgggtaccgtaacggtaacccgtttaccgggtttaacgtaaccgtttaacctaacggtaacgggtaacggttaaaccggtaccggacgggtaacccgaaagggggtaacgggtaacccgggtaggtaacccgtagttaacgttaaccgttaacgtacgtaactaaacgaggtaacgaacgtaaggtagtacggtacttcggtaggttgggtcgtacgggcggtaacgggacaacggtccaggtacccgtacggtaggtcccaacggtacccgtacgggccctaccggtccccgtaaccgg

SEQ ID NO: 202290 - DNA, 546 bp, Homo sapiens
  misc_feature: GYAE6OF02F2Z1W.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatataataaagacactgagaggccctacagagactcccctgacgcgatttctcgtggcctcagctcagggacagcagtccacgttgactatcgagtgaagtccgaggcgaggaggacgaggctgaactattactgtacaaacgagtaagacaagtaaggagtacgtagtagttgggtagttcgggcggagggaaccgaaggacgtacggtaccgttcgtacggtacgacggaccgaacggtcctacggccccctaccgg

SEQ ID NO: 202291 - DNA, 717 bp, Homo sapiens
  misc_feature: GYAE6OF02HRAJ6.21.46.E02.1.454.CMB.1.raw
  modified_base (263)..(263): a, c, t, g, unknown or other
  misc_feature (263)..(263): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatccacctgctctcgcgagatgggacctgaccaaaagaatatgacttattggtaccaanagaagccaggccacggccctgtcgttagtgatatataaagacacgtgaagacggtccctcgagagtactcccgtaggacgctactttctcgtcggcttccgagtctacgaggggacaggactacggtacacgtttacgacttagtacgtacgttaggaaccggttacgacgggtacgaagggtacggaacggagggtaccttaggtaacgttacgtttaacgtacgtaaacctaaaacgtaagggttaaacgaagtaacggtaacggtaacggtttaactacggtttaaaggtttcggggttacgggtttaccggggacccggggggtaacgggtaacccggaaagggtacccggttaacgggtaaccccgggtttaaccggtaacggggttcccgtaaccggtaccccgggtaaaccggtcccgtttacccgggccccccgtttaacccgggg

SEQ ID NO: 202292 - DNA, 752 bp, Homo sapiens
  misc_feature: GYAE6OF02GDYEQ.21.46.E02.1.454.CMB.1.raw
  modified_base (137)..(137): a, c, t, g, unknown or other
  misc_feature (137)..(137): n is a, c, g, or t
tcagtcgtcgctcgcacgaccggtgctcgatttagactcatctacagggaaagggggtgggtccaggaggcagaactctgggtgtctcaccatggcctggatccctctacttctcccccctctcactctctgcacgnggctctggacgcctactagtgacgctacgaacacacgccctaccgttggtgtactaggtccgtaccccgaaggaccacggaccggaccgaaggtacctacctacgtcgtccttcgcgacgaggtagtacggactacgaaacgaaaagtaacttgtcttattagttacgaaccaagaagacaccgacgaccgaccgtccgttagttagtacgtagtaattaagttaaacgaacgacgtagtaggacggaccgtccgtaagagacgtcctaccggagacgacgttactcgtacgtcgtacctacgcgtacgtacggaaggaccgcgacgtacgtaccgtagtacactacgtgaacgacgtaacgcggagacggtaaggacgacggtacgtacgacttaacgttaacttcgaacgtaaacgaaacggtagtaaaccgaggttaacggtaagttaacggttctacggtttaggggtttcggtaccggggttacgggacgggtaaccgggtaacccgtaagggttacccggtaacggtttaacccggttaacgggttaccggtaacgtaccccgggtaaaccgacggggttccccgtaccccggttaccccggttaccgg

SEQ ID NO: 202293 - DNA, 612 bp, Homo sapiens
  misc_feature: GYAE6OF02GJ8KV.21.46.E02.1.454.CMB.1.raw
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgacttattggaaccaacagaagccaggccacggcccctgtgttagtgaatataataaagacactgagacggccctagagagactccgngacgcgtattctcgtggcctcagtctcgaggacngcagtcagttgactatcagtagaacgtcgagcgaaggacggacggacggtctaggtaacttaacgttactacgtaacaaaacgagtaagaacgtaggtaagacggttaactagttaggttaggggttcggttacggggaccgggaacgggtaacccgtaagggtccgtacggtacccggttaaccgttacgggacgtaacccggacccgtaacgggtcccttaccccggtccccccggttaccgg

SEQ ID NO: 202294 - DNA, 530 bp, Homo sapiens
  misc_feature: GYAE6OF02FVUEY.21.46.E02.1.454.CMB.1.raw
  modified_base (322)..(322): a, c, t, g, unknown or other
  misc_feature (322)..(322): n is a, c, g, or t
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctgcagatggactgaccaaagaaatatgacttattggtaaccaacgagaagccgaggccacggacccctgtcgttagtgatataataaagacactgagaggccctanagagactccccgtgagcgtacttctacgtcggcctcgagcctcgagggacagcagtctacgtgactatcagtacgaagtccgaggacaaggacggaacgaggtacagtacgtattactgtaacaacagtagacagtaagagttacngtagttgggtgtaggnggaggacgagcgtacgtacgtcgtagcacgccgagctccgcctcgg

SEQ ID NO: 202295 - DNA, 932 bp, Homo sapiens
  misc_feature: GYAE6OF02H8AHH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggatcacctgctcgtgcagatggactacgaccaaaagaatatgtactttattcggtaaccaacgagaacgaccgacggaccgacggaccccgttgttacggttagtagtaacgttaattaacgttaaaagaaccgtacgtaggaacgtacgggtccccttagaacggtacggtaacttccccgtaggtaacgaccgttaactttcccgttcgttcgggtccttcccgtacggtccttaccggaacggggaaccgttacggaccggtaacgttcccgtaacggttttacgtaaacctttacgttaacccgtaagggtttaaccggaaacggttacccggtaaacggggaaccgtaaacgggggtaaaccgggtaaaccggggtaaccggttacggtttaaaccggtttaaaaccgttttaaacgttttaaacccggtttaaagttaaaccccggttaaaaaccggtaaacgggttaaaaccgggttaaactaaaccgggggtttaaagggttaaccgggttttaaaaccctacgggtttaaaacgggttttacgggggggtttaccggttacccggggggtaccggggttaaaccggggaaccggtaaacgggttacccggttacgggttaaacccgggtttaccccgttaacgggtaccggttaaaccggacccccgggttaaccgggtaccccgtttacccccgggcccccccggtttaacccgg

SEQ ID NO: 202296 - DNA, 644 bp, Homo sapiens
  misc_feature: GYAE6OF02IEW5S.21.46.E02.1.454.CMB.1.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctcctatgagctgacacagccaccctcggtgtcagtcgtccccaggacagaccggccaaggactcgacctgctctgcagatggactgaccaaaagaatngcttattcggtacaanagacgcaggcacgccctgtgttagtcgatataataaacgacactgagcggaccctgatacgactccctgacgacgtattaccgtctacggcctccgagtctacggacggggacacgtccgagttaccgtacgttacgtactactacgacggttagtaacggtcgaacggacgtaagggacggaacggacggtactacgtaacttacgttacgtacgtaaacgtaacgtaaggtaacgtaccgtaaggtacggacggtaacttcggtaggtttcgggttacggtcgggtacgggaacgggacgaacggtaccgtacggtacccgttaccggtaaggtaccgtacggacccgtaacgggtcccgtcccggtaccccggttaccgg

SEQ ID NO: 202297 - DNA, 586 bp, Homo sapiens
  misc_feature: GYAE6OF02JWIDY.21.46.E02.1.454.CMB.1.raw
  modified_base (250)..(250): a, c, t, g, unknown or other
  misc_feature (250)..(250): n is a, c, g, or t
  modified_base (269)..(269): a, c, t, g, unknown or other
  misc_feature (269)..(269): n is a, c, g, or t
  modified_base (456)..(456): a, c, t, g, unknown or other
  misc_feature (456)..(456): n is a, c, g, or t
tcagtcgtcgctcgcacgaccggtgctcgatttagactcatctacagggaaagggggtagggtccgaggaggcgagaactctgggtgtcgtcaccatggcctggatccctctacttctcccctcctcactctctgcacaggctctgaggcctcctatgagctgacacagcccaccctcggtgtcagtcgtccccaggacagacggccaggatcacctgcctctagcagatggactggaccaaaagaaatntgacttattggtaaccaanagtaagccaggccaggccccctgtagttagtcggatactataaacgacaacgtgaagacggccctacgaagaacgatcccctaggacgacgtaattctcgtcggctccgagccttacgagggactagcagttcacgttgactatcaagtgaagtcctagcaaggacgagaggctagactaagttacngtacaaagtacgtaagactagtaacgaggttataccgtagttacggtggttcgggacggtacgggaacaacggcgttaggaacccgttctaacggttcgaccgtaccgaggaccgtcgcccccgttacgg

SEQ ID NO: 202298 - DNA, 249 bp, Homo sapiens
  misc_feature: GYAE6OF02H5FOD.21.46.E02.1.454.CMB.1.raw
  modified_base (245)..(249): a, c, t, g, unknown or other
  misc_feature (245)..(249): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtccttccccctggcgccctgctccaggagcacctccgagagcacagcggccctgggctgcctggtcaaggactacttccctcgtctctactgagcgggctggcaaggcgcatagnnnnn

SEQ ID NO: 202299 - DNA, 566 bp, Homo sapiens
  misc_feature: GYAE6OF02JM2MX.21.46.E02.1.454.CMB.1.raw
  modified_base (248)..(248): a, c, t, g, unknown or other
  misc_feature (248)..(248): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
  modified_base (398)..(398): a, c, t, g, unknown or other
  misc_feature (398)..(398): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggaccggccaggatccacctgctctgcagatggactcgaccaaaagaaatntgcttaattggtaaccaacaagagccaaggtccacggcccctgtgttagtgatataataagactactgagacggccctanagagactcctagagacgtnttactcgtcggcctcgagcgtacgacggaacagctagtctacgttgaactntacgagtagaacgtaccaggacgaggaaggcgaagctagtactattactagtacaaanagtanacgagtagagtactacgtagttaggtgttcggaggacgggactaacggtctacggtaccttaccggtaggtaccacggaccacgggtcctcccgccccggttacg

SEQ ID NO: 202300 - DNA, 695 bp, Homo sapiens
  misc_feature: GYAE6OF02JJ17T.21.46.E02.1.454.CMB.1.raw
  modified_base (183)..(183): a, c, t, g, unknown or other
  misc_feature (183)..(183): n is a, c, g, or t
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (294)..(294): a, c, t, g, unknown or other
  misc_feature (294)..(294): n is a, c, g, or t
tcagtcgtcgctcgcacgaccggtgctcgatttagactcatctacagggaaagggggtgggtccgaggaggcagaactctgggtgtctcaccatggcctggatccctctacttctccccctcctcactctctgcacaggctctgaggcctcctatgagctgacacacgcccacccgttcggtntccagtcgtccccaggacagaccggccaggactcacctgctctgcagntggactgaccaaagaatntgcttatcgacanagagccaggccaggccctgtgtatgatataanaacgacactggtaacggacggacccctagaagaacgaccttcccgtaggtagaccgtaattccgtacgtaggtcctacccaggtcccgtacgaacggggactaacggcgtaacggttacctaaccgggtttaagaacccttaactaccgtaaggttacggaaccggtacccgtaggaccgaagaacggggtacgacggtactaggtaaccttagttaaccgtagtaaccaaaacgtagttaaccgaacgtaagtaaggtaacgttaacggttatacgggttacgggttaggtaccggggtacggtaacggggtacccgtaaaggcccgttaagggacccgttaccgttaacggcgtaaccggacccggtaaggtcccgttcccggtacccccgttaccggg

SEQ ID NO: 202301 - DNA, 766 bp, Homo sapiens
  misc_feature: GYAE6OF02H70JO.21.46.E02.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacacgccaccctcggtgtcagtcgtccccaggacagacggccaggatcacctgctcngcagatcggactcgaccaaaagaaatacgtgtactttagttcggtaaccaacgaaggaacgaccgaaggacccgaccgggtcccccgttggttggtttaacgtagaacgtttaattaaaacgttaaaaacggtacctaacgtaggaacggaccggtccccttacgaacggacgtaacttccccgtagacgaccggtactttccgttacgtcgggtcctaccggacgtcgtacggacgggtacacggcacgtcgtacggtttcgacttagtacgtagtacggaacgtccgaagggtaccgaagggaaacgggacggtacgggtccgttaacggtaacttaacgtttaccgtacggtaaactaaacggtaagtaaacgacgtaaaggttaaggtacggttactacgggtacggttttacggggtacgggtttaccgggaccggggtaacgggtaaccgacgggtacccggttacggtaaccccgggttccgttaacgggaccgaccggaccccggtaacgggtcccgttccccgggtacccccttccggg

SEQ ID NO: 202302 - DNA, 600 bp, Homo sapiens
  misc_feature: GYAE6OF02IQCUJ.21.46.E02.1.454.CMB.1.raw
  modified_base (397)..(397): a, c, t, g, unknown or other
  misc_feature (397)..(397): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctgcagagtggacctgaccaaaagaaatatgtacttattggtaaccaacagaagccaggccacggcccctgtgttagtgatatataaacgacacgtgaaggacggccctacgaagagtactcccgtgagcgtatttacgtcgtcgctccagctacgaagggacagcgacgtctacggttnactatacgagtagaacgtcgaggacgaaggacggacgaggctacgaacttagttactgtaacaaactaggtaagacgtaagtaaggtacgttactacgtagttgggtacggttcgggacgggtaacggacgaaggtccgtacggtacccggtccgtacgggtacaccggtacccgaacggtccgtcccggaccccgttccggg

SEQ ID NO: 202303 - DNA, 833 bp, Homo sapiens
  misc_feature: GYAE6OF02HW9M1.21.46.E02.1.454.CMB.1.raw
  modified_base (130)..(130): a, c, t, g, unknown or other
  misc_feature (130)..(130): n is a, c, g, or t
  modified_base (137)..(137): a, c, t, g, unknown or other
  misc_feature (137)..(137): n is a, c, g, or t
tcagtcgtcgctcgcacgaccggtgctcgatttagactcatctacagggaaagggggtgggtccaggaggcagaactctgggtgtctcaccatggcctggatccctctacttccctccctctcactctcngacacgnggtctcgtcggacgtcccttactagtgcgtcagaaccacgaccgaccctacccggttcggtcgtcgagtcccgtacccgaaggacgaacggaccggacgaaggtactccacgtcgccttgacgacgagtacggacggactaacgaaacaaaaagtaattgtcgttacgtttagtacgaaacaacgagacgacgacggaccgaccggtccgttaggtagttagagtaataataaagtaaacgactacgaggtaacgccgacctagagacgtacctccgagacgtacttactttcgacggtcgtactacgacgtccgtaacgggacggtacacgtacggtacgtccgtaacgtttacgtaacttacgtaaggtacgtaacggtaacgtcggaacggtacggaaacggggtacggaaacgggtagttaaccgtttaaacgaccttttaacggtaacgtaaggtaaaacccgtaaagggtaacggtaaacgaacgggtaaagggttaaccgggttaacgtttaccgttagggttaagggggttccgggggttttaacgggaccggggaacggggaaccggttaaccgggtaacggttcccggggttaacgtaacccggggtttacggtaaccgggtaccggaacccgggtaaccggttacccgggttaccgttccccccgggggtaccccgttaaccggg

SEQ ID NO: 202304 - DNA, 616 bp, Homo sapiens
  misc_feature: GYAE6OF02G5AEF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagagtggactgaccaaaagaaatatgcttattggtaccaacagaacgccaggccaggccccctgtcgttagtgatataataaagacactgagacggccctagagagactccccgtagagccgtaattcctcgttaggcctaccgagtcctacgaggggtaacaggcgacgtacgtaaccgttgtactatcgagtcggtaacgtcgaggcaaggaggacgaggactaggtactacgttactagtaacaaactaggtaacgacgtaagtaggtaacggttaccagttacggttggggttaggtcgggacgggaacgggtaccgaaggtccgtacggtacccgttacgtacggtaccgaccggaacccggaggtcccgtcccggtcccccgttaccgg

SEQ ID NO: 202305 - DNA, 665 bp, Homo sapiens
  misc_feature: GYAE6OF02JYVSU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctgcagatcggactgaccaaagaatatgcttatggtaccaacagaacgcacggccaggcccctgtcgttagtgatactataaagacactagacgaacggtccctacagacgactccccgtagacgcgtattcctactgggcctaccgagccttacgacggggtacaacgtcgaacgtactaacgtttgaacgtatccgtaaggttacgaaacggtcctaaggacgtaaggaaggtaccggaagtccgtagaccttaagttaccgtacgtaccgaaacgtacggtaaagtaaccgtaaggtaaacggtggttaaaccttcgtaaacggtttggggttacgggtttcgggaacgggacgggtaaccgtaagggccgtttaacgacccgggttaccgtaacggttccgaaccggtcccggaacggtacccgttacccggtaccccgttacccgg

SEQ ID NO: 202306 - DNA, 820 bp, Homo sapiens
  misc_feature: GYAE6OF02GW03Z.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagagtggactgaccaaaagaaatatgtacttagttacggtaacctaaacaacggaaacgaccacgggacccgacggccccccttaggttcggtttaacgtaggtaacttaattaaagtaaaacggaacctacgttaacggaaggtacgggtaccccttacgaggaacgtaacgtccccgtaggtaacggacggtactttccgtaccgttcggtccctaccgtaacggtcttaacggaacggggtaaccgacggtaccggaacggttaccgtaaccggtttacgaaccgtttaacgttacccgtaaggtaacggtaaacggttacccggaagggaccgtaaacgggaacgggaaccgggtaacgggtacggttacgtaacgtttaactttaacgtaacgtaacgtaaacgtaaaggttaacgaaacggtaagttaaagggtaaccgtttaacgttacggttaacgggtttacggggttacgggttacgggtacggggtaccgggaaccggtaacggttaccggtaccggtaacccgttaccggttaacggtaccgaccggtaccccggaacggtcccgttacccggtcccccggttacccgg

SEQ ID NO: 202307 - DNA, 609 bp, Homo sapiens
  misc_feature: GYAE6OF02F20LU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgactttattggtaaccaacagaagccaggccacggccctgtgttagtgatataataaagacactgagacggccctagagagactcccgtgacgcgtattctctcggctccagctacgagggacagcagtcacgttagactatacgagtagacgtacaggcaggacggacgaggctagacttaattctagtacaaacgtagtaagactaaggtagtaagttactacgtaggtttcgggttaggtttccgggacgggtaacgggaacccgtaaacgggtccgttacgggtaaccccggttccggttaacgggttaccgaaccggaccccgtaacgggtccccgtacccggtcccccccggttacccggg

SEQ ID NO: 202308 - DNA, 611 bp, Homo sapiens
  misc_feature: GYAE6OF02GP0VM.21.46.E02.1.454.CMB.1.raw
  modified_base (318)..(318): a, c, t, g, unknown or other
  misc_feature (318)..(318): n is a, c, g, or t
  modified_base (348)..(348): a, c, t, g, unknown or other
  misc_feature (348)..(348): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgacttattggtaaccaacagaagcaggccaggcccctgtgttagtgaatatataaagacactgagacggccctanagagatccctgagcgattctctggctccanctcgagggacagcagtctacgtgactagtcagtgaacgtccgaggacaggacgggaacgaggtactagtaacgttattacgtagtaaccaaaacgtaaggttaacgaacgtaagtaaggtaaggttacgttacgtaaggtttggggttacgttaccgggacggggtaacgggaacccgaaaggtcgttaccggtaacccgttaccgttaacgggtaccgacggaaccccgtaacgggtcccgtccggtaccccccgttccggg

SEQ ID NO: 202309 - DNA, 571 bp, Homo sapiens
  misc_feature: GYAE6OF02JGOVQ.21.46.E02.1.454.CMB.1.raw
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (439)..(439): a, c, t, g, unknown or other
  misc_feature (439)..(439): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgtcttattggtaccaacagaagccaggccaggcccctgtcgttagtgatatataaagacatgagacggccctgagagtactccccgtgacgcgtacttctacgtggaccttccgagtctcgagggacagcagtcngttnactancagtgaacgtcgagcaggaggacgaggctgactattactgtacaaactggtanacgagtaagtacggttactacgtagtttgggtagtttcgggacggtagggaacccgtaggtccgtggtaacccgtccggttaggacctaccgggacccgaacgggtgtacccccccccccggtgttacccgg

SEQ ID NO: 202310 - DNA, 644 bp, Homo sapiens
  misc_feature: GYAE6OF02FZNRD.21.46.E02.1.454.CMB.1.raw
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaccaacagaagccaggccaggcccctgtgtagngatataataaagacactggagacggccctnagagactaccccgtgacgacgtacttcctcgtcgggtccttacccgagtccgtacgaacggggaaccaggaccaagtccgtaacggtttgaaccgttatcgaagtacggaacgtcccgaggacgaaggaacgggacggtaacgggtcgtagtaacttagttaacctagtaacaaacgtagtaagacgtaagtagaggttactacgtaaggtttggggttaggtacgggacgggaacgggtaacccgtaagtaccggtacggtaacccggttcgttaacgggtaccgacgtaaccccggaaggtccctacccggtacccccgtaccggg

SEQ ID NO: 202311 - DNA, 612 bp, Homo sapiens
  misc_feature: GYAE6OF02IPZ2X.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgacttattacggtaaccaacaagaacgaccgagggacccacggtccccgtgttggttagtagataataataaagacactggagacggccctacgagagactcccgtagagcgattctctcggctccagctacgaagggaccagacacggtctacgttagtactactacgaggtagaaacgtccgaggacgaaggaggacggaggctagaacttacgttaactagtaaccaaagtagtagacaaggtaagtagtacttagtaggttgggttcgtacgggtacgggaaggtaccggtaaacgtccgtacggtaaccggtccgttaaggccgaacgtcccgaacgggacgttccccggtccccgtacccggg

SEQ ID NO: 202312 - DNA, 692 bp, Homo sapiens
  misc_feature: GYAE6OF02IBBKS.21.46.E02.1.454.CMB.1.raw
  modified_base (226)..(226): a, c, t, g, unknown or other
  misc_feature (226)..(226): n is a, c, g, or t
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtggtccaggaggcagaactctgggtgtctcaccatggcctggatccctctacttctccccctctcactctctgcacaggctctgaggcctcctatgagctgacacagccaccctcggtgtccaggtcgtaccccaggacagacggccaggactcacctgctctgctagngtggactagaccaaagtaatntagtacttagttacggtacaacagaacgcgtacggccacggaccctgttcgttagtagatataagtaaacgacagtagagacggccctagagagtaccgtccagacgacgtacttccgtcgtcggccttccgacgtacgtacgacggggaaccagacgtacgtacgtacggttacgtacttaactcgtaacggttacggaaacggtacgacggtacggtaacggacgggaacgacgggtactagtaacgttactttacgtacgtaaccgtaaagtacggtaacgtacgtaagtaacggaacgtttaacctgttaaaggtttggggttacgttacggggacggggttaacggaaccgtaagggtaccttacgggtaaccccgtaggttaccggtaccgtaaccggacccggtaacggtcccgtaccccgggtacccgttaccccgg

SEQ ID NO: 202313 - DNA, 583 bp, Homo sapiens
  misc_feature: GYAE6OF02GKIOR.21.46.E02.1.454.CMB.1.raw
  modified_base (240)..(240): a, c, t, g, unknown or other
  misc_feature (240)..(240): n is a, c, g, or t
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaagaaatntgcttattcggtaccaacagagccaggccaggcccctgtgttagtgatatataagacactgagagccctcagagatcccngacgcgtattctcgtggcctaccagctcgaggactagacgagtccacgttgaactatctaggtgaagtccgaaggcgaaggacggaacgaggactgtaacttaattacgtagtaccaaacgagttaacgagtaggtaagacggttaacgtcctaaggttgggttacggttccgggacgggtaacgggacccaaggtccgtacggacccggttaccgtaacggtccgaacgtcccgaaggtcccttaccggcccccgttaccgg

SEQ ID NO: 202314 - DNA, 706 bp, Homo sapiens
  misc_feature: GYAE6OF02JQ9QP.21.46.E02.1.454.CMB.1.raw
  modified_base (177)..(177): a, c, t, g, unknown or other
  misc_feature (177)..(177): n is a, c, g, or t
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctcctatgagctgacacagccaccctcggtntccagtcgtccccaggacagacggccaggatcacctgctctgcanatggactgccaaagaatngtcttatgtaccanagacncaggccaggccctgtcgtagtgatatataaagacactgagacggccctgagagactcccgtaggacgcgtaacttcctacgtcgggtccttccgacgcttaccggaacgggaacacggaccgacggttacctaacggtttagaaccgttatacgtaaggttacggaaccggttaccgaacgggacaagggaacggaacggtacgggtacgtacgtaacttaaccgtttaacgtacggtaaacgaaaccgtaaggttaaccgaagttaaacggtaaggtaaccggttaacgttacgttaacggttcggggttaacgggttccgggacgggtaacgggtaacccgtaacgggtaccgttaccgggtaaccccgttacggttaccggttaccggtaaccggtacccggtaaacgggtccccgttaccccggtacccccggtttacccggg

SEQ ID NO: 202315 - DNA, 597 bp, Homo sapiens
  misc_feature: GYAE6OF02IF3XN.21.46.E02.1.454.CMB.1.raw
  modified_base (179)..(179): a, c, t, g, unknown or other
  misc_feature (179)..(179): n is a, c, g, or t
  modified_base (242)..(242): a, c, t, g, unknown or other
  misc_feature (242)..(242): n is a, c, g, or t
  modified_base (316)..(316): a, c, t, g, unknown or other
  misc_feature (316)..(316): n is a, c, g, or t
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtntcagtctccccaggacagacggccaggatcacctgctctgcagatggactgacaaaagaaatntgtacttattggtaaccaacaagaagccagccaggcccctgtgttagtgatatataagacactgagacggcctnagngactccagagcgtattctgtcgctcacgtctacgagggacagcgagtcgaacgtttgacttactcgagtagaacgtccgaggacgaaggtacgggacggaggcgtagtacgttaacgtttcgttacgtaccgtaaacgagtagtaacgaacgtaaggtaacggtactacggtaggtttcggggttggttaccgggcgggaacgggtacggtaagccggtacggtaccgtccgttaacggtccgtaacggcccgaacggtcctcccggccccttccggg

SEQ ID NO: 202316 - DNA, 535 bp, Homo sapiens
  misc_feature: GYAE6OF02HGK58.21.46.E02.1.454.CMB.1.raw
  modified_base (312)..(312): a, c, t, g, unknown or other
  misc_feature (312)..(312): n is a, c, g, or t
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgcttattggtaccaacagaagccaggccaggccccctgtgttagtgatatataaagacatgagaggccctnagagactccctgagcgattctctggcctcagctcgagggacagcagtcacgttgactatcagtgaacgtccaggcagaggacgaggctgactattactagtacaaacngtaagacagtagagtactcgtagttgggtgttacggcgggagggaccgtaagcgttagacccgttaccgtaggtaccgacggtaccccgaaggtcctaccggcccccgttaccgg

SEQ ID NO: 202317 - DNA, 608 bp, Homo sapiens
  misc_feature: GYAE6OF02IKG9U.21.46.E02.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgtactttattggtaaccaacgagaacgccaggccacggcccctagtgttagtgatataataaagacactgagacggcctnagagactcccgtgagcgtattctacgtggcctccgagtctcgagggacagctagtactacgttgacttagtacgagtacgtaacgccgagacgaggaacggacggagacgtacgaacttacttacgtacgtaaccgaaagtagtaacgacgtaagtagtaacgttactacgttaggtttacgggtcggttacggggacgggtacggtaaccggaacggtacgtaccggtaacccgtacgtacggtacgaccggacccgaggtcccgtccccgtccccgtaccgg

SEQ ID NO: 202318 - DNA, 588 bp, Homo sapiens
  misc_feature: GYAE6OF02I62HB.21.46.E02.1.454.CMB.1.raw
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (425)..(425): a, c, t, g, unknown or other
  misc_feature (425)..(425): n is a, c, g, or t
tcagtcgtcgctcgcacgaccggtgctcgatttagactcatctacagggaaagggggtaggggtccgaggaggcagaactctgggtgtctcaccatggcctggatccctctacttctcccctcctcactctctgcacaggctctgaggcctcctatgagctgacacagccaccctcggtgtcagtgtccccaggaccagacggccaggatccacctgctactgcagatggactgaccaaagaaatatgcttatggtaccaacagagccagccaggcccctgngttagngatanataaaggacatagaggacgccctnagngatccngancgattcnctggctccganctcagggacagcagtcaacgttnactatnagtcgagtccgaggtacgaggacggaggaggtctaggacttattacgtntaacaacgtagtaacgaagtacgtaaggtagggtaccttaacggtagttagggttacggttcgggtacgggacgggttaccggaaacgggtctacggtacccggttacgtaccgggtacgtacggtaccccgaaggtcccgtacccggtcccccgttaccggg

SEQ ID NO: 202319 - DNA, 659 bp, Homo sapiens
  misc_feature: GYAE6OF02GLDQ3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgtcttagttacggtaaccaacgaagaacgccacggccacggcccctgtgttagtgatatataaagacactaggagacggcccagtaagacgactacccgtgacgtacgtactttctcgtcggctccgtacgctacggacgggactagacctagtccgtaacgttacgaacttatacgtacgtaggtaaacgtaccgaggaccgtaagggaacggacggaacgtcgtacgtaacttatttacgacgtaacaaaacgtaggttaacgaacggtaaggtaacggtaacggttaacctacgttaggtttggggtacgtttacgggggacgggtaacgggtaaccgtaaggtccggtaccggtacccggttccggttaagtccgacggacccgaacggtcctacccggcccgttacccgg

SEQ ID NO: 202320 - DNA, 700 bp, Homo sapiens
  misc_feature: GYAE6OF02ICOZ4.21.46.E02.1.454.CMB.1.raw
  modified_base (227)..(227): a, c, t, g, unknown or other
  misc_feature (227)..(227): n is a, c, g, or t
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctctatgagctgacacagcccaccctcggtgtcagtcgtccccaggaccagaccggccaggatccacctgctctgcagntggactcgaccaaaagaatatgtctttattcggtaaccaacagaagaccgaggccacggccccttgtcgttagtagtataataataaacganacgtagaaggacgccctacgaaggacactcccgtaggacgacgtacttctcgtacggtcctaccgacgtacgtcgaacgggacacgcgtaacgtctaacggttacgacttacgtacgtacgtacggtaacgtccgaacggtacgaacgggtaacgggacggtacggtacgtaggtactttaacgtactacgtaaccaacgtaacggtaaacgacgtagggttaagtacggttacttacgtaacgggtttgggttaccgggttacgggacggggacgggtaaccggtaacggtccgtaacccggtcccggttaacccggttaacgggtcccgaacccggtaaccggaccgggtcccgttaccccgtccccgggttaacccgg

SEQ ID NO: 202321 - DNA, 632 bp, Homo sapiens
  misc_feature: GYAE6OF02HBCWG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatatgacttattaggtaaccaaacgaagaacgaccgaggaccgacggcccctggtcgttagtgattataataaagacacgtagacgacggcctacgagacacctaccgtagacgacgtacttaccgtcgtcggcctaccgacgtctacggaacgggtacgacgacgacgtacctacgttacgaactagtaccgtaaggtacgtaacgtaccgaacggacgtaaggaacgggacgacggtactaacgtaacgttaattacgtacgtaacgaaacgtaagtaacgtacgtagtaggtaacgtacgtacgtaggttgggtagtcgggacgggacgaacgaacgtacgtacgaccgtacgtaggtaccacgaccgacggccgtaccgtcccgtaccgg

SEQ ID NO: 202322 - DNA, 691 bp, Homo sapiens
  misc_feature: GYAE6OF02HDRK9.21.46.E02.1.454.CMB.1.raw
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
  modified_base (256)..(256): a, c, t, g, unknown or other
  misc_feature (256)..(256): n is a, c, g, or t
  modified_base (523)..(523): a, c, t, g, unknown or other
  misc_feature (523)..(523): n is a, c, g, or t
  modified_base (532)..(532): a, c, t, g, unknown or other
  misc_feature (532)..(532): n is a, c, g, or t
  modified_base (543)..(543): a, c, t, g, unknown or other
  misc_feature (543)..(543): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacngcccacccgtggtntcagtcgtccccgaggacagcggccaggatcaccttgcctgtcgactagacgtgtacacgtaaacgaaagtaacgtntcgttacttacgttacgtaaccgaacgaagaacgcgaccgaccgacgtcccgtagttacgtagacgtatactaagtaaacgacgtacgtagacggaccgtccgtaacgaggtaacgtacctccgtacggacgtactacgtttcgtacgtaccgtccgtaccgacgtcgtaacggacgaccgacgtacgtacggtactacgttacgtaacgtcgttaggaacgtagtaccgtaggacgaggtacgacggagacgttacgtagtacttntaaccgtanaacgtaaacgngtaacagtacgtaagacgttcgtaggtaggttcggttacggttccgggaggaaccggtacgtaccggacggttaacccgtacccgggttacgtaaacggtcctaacccggaccgtaaccgggtccttaccccggtcccggttaacccg

SEQ ID NO: 202323 - DNA, 801 bp, Homo sapiens
  misc_feature: GYAE6OF02HOIA4.21.46.E02.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcanaggctctgaggcctcctatgagctgacacagccaccctggtgtcagtcgtccccaggaccagacggccaggatcacctgctctgcagatggactgaccaaagaaatactgtacttagttacggtaaccaaacgaagaacgaccaacgggacccacggtacccccgtaggtttacggttaacggtcgtaaacttaagttaaagttaaaaacggacctaacgttaacggaacggacggtaccccttacgaacgaaggtacctaccccgtaggacgtaccggtattacccgtacgttcggtaccctacgtaacgaccgttacgacggggtaacaacggaccgtaacgtacgtaacggttacgaacgttactacgaggttacgaacggtaccgaaggtacgaacggtaagggaccggaaggtaccgtagtaaactttaacgttacgtaacgttaaccaaaacgtaaggttaacgaaaccgtaaaggtaaccggtaaacgggtttaacttaaccggttaaaggtttcggggtaggttacccgggggtacggggaaccgggtaacccggtaaacggtaccggttaccgggttaacccgtaccggttaacggttacccgaacggtaccccggtaaccgggtacccgttacccgggtaccccccttacccgggg

SEQ ID NO: 202324 - DNA, 684 bp, Homo sapiens
  misc_feature: GYAE6OF02GFKVO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgctttattggtaaccaacaagaagccaggccacggcccctgtggttggtcatccatgaggacaggagacgaccccgtcgggactccccgtgagagacttctcgtggcctacccaacgtacgacgggacgggttcggaccgtaccgttgtactttccgtacgtagggtcgggggccctaggggtcgggaggtagtacggaagtcgtacgaccttaacgtacgttagttaaccgtcacggcaacgacacggtacgtaaggttcggtagacgtacggaacgggggtctaacggttccggggaacgggacggggtaaccggtacgggtttaccggtacccggttacccggttagggtaccggaaccgggtaccccggtaaacgggtcccgttcccgggtaccccccgttaccgggtacccgttaccgttcccgtttaacccccgg

SEQ ID NO: 202325 - DNA, 666 bp, Homo sapiens
  misc_feature: GYAE6OF02IK3W3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtgtcagtcgtccccaggacaggacggccaggatcacctgctctgcagatggactgaccaaaagaaatatgtactttattacggtaaccaacaagaacgccaggccacggccccctgtgttagtagataataagtaaaagaccacgtgaaggcggccctacgagagtactcccgtagacggtacgtactttcgtcgtacggtcctccgagtcctacggaagggaccacggccgtacgttaccgtacgtttcgaacttaacgtacgtaggtaaggaacgttcccgaagggacgaaggaagggaccggaagggtctacgtaacttaacgttacgtacgtaaccaaagtacgtaacgacgtaagtaagtacggtaccttagtaggtttggggttacggttcgggacggtaacgggaacgtacggaccgtacggtacccgttacgtaaggtccgaccggacccgaaggtcccgtacccggtccccgtacccgg

SEQ ID NO: 202326 - DNA, 620 bp, Homo sapiens
  misc_feature: GYAE6OF02H80V7.21.46.E02.1.454.CMB.1.raw
  modified_base (293)..(293): a, c, t, g, unknown or other
  misc_feature (293)..(293): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
tcagtcgtcgctcgcacgaccggtgctcgatttagactcatctacagggaaagggggtgggtccgaggaggcagaactctgggtgtctcaccatggcctggatcctctacttctcccctcctcactctctgcacaggctctgaggccctcctatgagctgacacagacccacccttcggtgtcgaacgtcgtccccaggacacgtaccggccaggactcaccgtgctctgcagatggactgaccaaagaatctgacttgtacggtacaacagagccaggccacggccctggtnttacgtgattataagtaaaacgacacgttgaacgacggtcccctgaagagtactccctagcgcgtattcttcgnggtcctccagtctacgnggaacngcatcgtacgtgactgtcgagttcgaagtcctaggacaaggaggacgtacggcttagaacgtactttaacgcgtaccgtaaacgtaggtaaacgtaccgtaaggtagaaacggttactccgttaaaggttcgggttagttaccgggacggtaaccgggtaacaggttaccgtcgaaccggttacccgttagggacgaccgtaccgacgggtcctcccggtaccccttcgg

SEQ ID NO: 202327 - DNA, 638 bp, Homo sapiens
  misc_feature: GYAE6OF02G80OS.21.46.E02.1.454.CMB.1.raw
  modified_base (614)..(614): a, c, t, g, unknown or other
  misc_feature (614)..(614): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggcaggatcacctgctctgcagagtggactgaccaaaagaaatagtgctttatcggtaaaccaacgaagaacgccgacggaccacgggcccctggttagttagtgaataataacgtaaaagaccactaggaagaacggccctgaagagtactcccgtagacgcgtactctacgtcggtacctaccgaacgtccacggaacggggacacggactacgtacggtaccgttagaaccttagtacctaagggtagtaaaccggtccgaggacaagggaaagggaccggttaggacttacgggtaaccttagttaacgtcgaacaaacgagttaacgacgtaagtagacgtaactgtaggtggtcgtcgggacggaggaactacggacgtcgaaccgtcggttacgtagaccgtaccgnggtaccgttcccgaccccgttcgg

SEQ ID NO: 202328 - DNA, 539 bp, Homo sapiens
  misc_feature: GYAE6OF02FRCL7.21.46.E02.1.454.CMB.1.raw
  modified_base (417)..(417): a, c, t, g, unknown or other
  misc_feature (417)..(417): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaagacactgagaggccctcagagatccctgagcgattctctggctccagctcagggacagcagtcacgttgactatcagtgaagtccaggtcagaggacgaggctgactattactgtacaaanagtaagacaagtagaggttactcagtttgggtgttcgggcggtaagggaccgtaaggccgtacggaacccgtccgttaagggttacgtaccgtacggacgtcgtaccccgtccggttacccg

SEQ ID NO: 202329 - DNA, 649 bp, Homo sapiens
  misc_feature: GYAE6OF02IPYS4.21.46.E02.1.454.CMB.1.raw
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (316)..(316): a, c, t, g, unknown or other
  misc_feature (316)..(316): n is a, c, g, or t
  modified_base (332)..(332): a, c, t, g, unknown or other
  misc_feature (332)..(332): n is a, c, g, or t
  modified_base (467)..(467): a, c, t, g, unknown or other
  misc_feature (467)..(467): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctcngcanatggactgaccaaaagaaatntgnttatggtaccaaangaaanccaggccaggccctagtnttagtgatatataaaagcactgagaggcccctanagagatccctagacgngtaacttctagtcggctaccgaagccctgaaacgggtacaaacgcgtagtaacctacgttaggtaacctaatccgaagttgaaacgttccgaaagggcaaggtaaggaacgtaaggcgttagaacctaattaccngtaacgaaacaggttaagacaaagggtaagtaaggtacttacgagtttacggggtacgtttacgggaccggggtaaacgggtacccgaaaacgggtccttaagggggtaaccccgttacccgtaaggggttccaaaccggtaccccgaaaaggtccccgttaccggaccccccttaccgggg

SEQ ID NO: 202330 - DNA, 560 bp, Homo sapiens
  misc_feature: GYAE6OF02JY6TT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgcagatggactgaccaaaagaatatgcttattaggtaccaaacgagaagccaggccacggcccctgtgttagtgataatataagacactagagacgcctgagagactcccgtgagtcgattcgctggcctcagctcgaggacagcagtcagttgactatcagtgaagtccaggacagaggacgagctagacttatactagacaagagtacaacgtagtaagtacgtacgttacgtgttagggtcgttacgggacggtaacggaccggtaagtaccggtgtaaccccggttcttaacgggcgtacggacccgtaacggccggttacccgcccccggttacgg

SEQ ID NO: 202331 - DNA, 671 bp, Homo sapiens
  misc_feature: GYAE6OF02G6PXR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactggaccaaaagaaatatgacttattggtaaccaacgagaacgaccaggaccacggcccctgtgttagtgatataataaagaacacgtgaagacgcctacagagactcccctgagacgtattcgtcgtacggtctccagtctacggagggtaccagacgacgtacgtaacgttcgaactatcaaggttagaacggtccaggacgaggacggacgaggtcctagtaacttattaacgtgtaacctaaacgagttaacgaacgaaggttaagaacggttaactccggtaagtttacggggttagggttaccggggtacggggtaacggggaaaccctaacgggtacggttaaccggggaccccgtttaacccggttaacgggtacccgtaccgggtaaaccccggtaacgggtacccttccccgggtacccccccggttacccggg

SEQ ID NO: 202332 - DNA, 724 bp, Homo sapiens
  misc_feature: GYAE6OF02IG0BK.21.46.E02.1.454.CMB.1.raw
  modified_base (233)..(233): a, c, t, g, unknown or other
  misc_feature (233)..(233): n is a, c, g, or t
  modified_base (574)..(574): a, c, t, g, unknown or other
  misc_feature (574)..(574): n is a, c, g, or t
  modified_base (619)..(619): a, c, t, g, unknown or other
  misc_feature (619)..(619): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacgaggctctgacggcctcctatgagctgacacacgcccacccgtcggtgtacagtccgtccccaggacaggaccggccgaaggactccacctgctcgngacgagtagtggacacggaacctaaaaggaaattcgtacgtacgtttaagtttaccggtaaaccctaaacgaaacggaaacggtacccaaccggggaccctaaaccggggtaccccccgttagggtttccggtttaacggtacggtaacttaaagtttaaaagtaaaaaccggaaacctaacgttacggaaacggaccgggtaccccttacgaaggaacgtaacgttcccctaaggacggtacgtaactttccgtacgttcggacctaccgtaacgccgtacgaacgggacgacgacgtacgtacgacgttcgaactatacgtagtacgagtccgaaggtnaacggaacggcgaggtctacgacgttataacgtctaacaacgtanaacgtacgaagtagacgtactcgagttcggtaggtacgacggaacgtaccgaagtacgtacgaccgttacacggtacgcgaccgtagtacctccgtccccgtacg

SEQ ID NO: 202333 - DNA, 609 bp, Homo sapiens
  misc_feature: GYAE6OF02JOTXR.21.46.E02.1.454.CMB.1.raw
  modified_base (239)..(239): a, c, t, g, unknown or other
  misc_feature (239)..(239): n is a, c, g, or t
  modified_base (388)..(388): a, c, t, g, unknown or other
  misc_feature (388)..(388): n is a, c, g, or t
tcagtcgtcgctcgcacgaccggtgctcgatttagactcatctacagggaaaggggtgggtccgaggaggcagaactctgggtgtctcaccatggcctggatccctctacttctccccctcctcactctctgcacagctctgagcctcctatgagctgacacagccaccctcggtgtcagtgtccccaggacagacggccaggatcacctgctctgcagatggactgaccaaagaaatntcgacttagttaggtaccaaacagaagccaaggccacggcccctgtgttagtgatagtaataaagacactgagacggtcctacagacagtccctggagcgtaattctctaggctccagcgtcgaaggacagctagtactacgtgaactntagtagagtacgtacgagacgtaggacggacgacggctagtacgttaacttactacggacaaacgtagtaacgtacgtaaggttacgtaggtaacgtacgtacgttaggggtacgtacgggtacgggaacggaccgaaggtccgttacgggacccgttaaccgttaacgggtacgtacccggacccgtaacgggtcccttaccggtcccccgttaaccggg

SEQ ID NO: 202334 - DNA, 601 bp, Homo sapiens
  misc_feature: GYAE6OF02FZVMW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaaccaacagaagcaggccaggcccctgtgttagtgtatataataagacactgagaggccctcagagactcccgtgacgcgtattctcgtggcctccgagctacgagggacacgcagtcacgttagactatcgagtagaacgtccgaggacaggacggacgaggactagtacttaattacgtgtaacaaacgagtaagacgtaagtacgtaggttactaactaggtttagggttacggttacgggacgggtaacgggaccgaacggtacctacggtaacccggttacccgtaggtacccgaaccggtaaccccgtaacggtcccgttacccggcccccgtttacccggg

SEQ ID NO: 202335 - DNA, 893 bp, Homo sapiens
  misc_feature: GYAE6OF02F8VAM.21.46.E02.1.454.CMB.1.raw
  modified_base (179)..(179): a, c, t, g, unknown or other
  misc_feature (179)..(179): n is a, c, g, or t
  modified_base (244)..(244): a, c, t, g, unknown or other
  misc_feature (244)..(244): n is a, c, g, or t
  modified_base (264)..(264): a, c, t, g, unknown or other
  misc_feature (264)..(264): n is a, c, g, or t
  modified_base (343)..(343): a, c, t, g, unknown or other
  misc_feature (343)..(343): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtntcagtcgtccccaggacagacggccaggactcacctgctctgcagatggactgaccaaaagaatntgacttagttggtaaccaanagaagccaaggccaacggcccctgtcgttagtacgtaataataactaaaagaccaacgtaggaagaacggtccccgtanaaggaacgtactaccccgtaggacgacgtactttacctcgttacgggtcctacccgtaagtaccgttacgaaacggggacccaaggacccgtaacggtttaccaacgggttttaacaaccgtttaaacgtacggtaaacggtttaaacggtaaaccggtttccccggaaacgggtaccggaaacggggtaacgggtaaaccgggtaaccgggttaaccgtaacgggtttaaacccggttaaacgttttaaaccggttaaccggtaaacccgttaaaaaaccggtaacgggttaaaccggtaaaccgttaaaacggggttaacggttaaaccgggtttaaccgttaacgtttaaacgggttttaccggggggttacgggttttacccgggggaacgggggtaaccgggtaaaaccccgggtaacgggtaacccggtttaaccgggtaaccccggtttacccggttaaacgggggtcccgtaaaccggggtaaacccccggtaaccgggttacccgggttaccccggttacccccccgggtttaaccccggg

SEQ ID NO: 202336 - DNA, 769 bp, Homo sapiens
  misc_feature: GYAE6OF02JT3T4.21.46.E02.1.454.CMB.1.raw
  modified_base (184)..(184): a, c, t, g, unknown or other
  misc_feature (184)..(184): n is a, c, g, or t
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
tcagtcgtcgctcgcacgaccggtgctcgatttagactcatctacaggaaagggggtggggtccgaggaggcagaactctgggtgtctcaccatggcctggatccctctacttctccccctcctcactctctgcacaggctctgaggcctcctatgagctgacacagccaccctggtgtcagtntccccaggacagacggccaggntcacctgctctgcagatcggactgaccaaaagaatntgactttagttcggtaaccaataacgaaagcccgaagcctacggccccttagtcggtaatcgaatanagtaaacgacagtggaagtcggaccctagaagngtactccgtaggagtccgtattccgtacgtggccttaccggagtacacggtacggggaacctaacggccctaaacggttcccgtaacggtttaccgtaacctttaacggtacccgtaagggttaacgggtaaaacccgtcccgggttaaaacgggctaaaccgggggaaaggggtaaccgtacggggtacgtttaacccggttaacgttaaccggttttaaccgtaacggtaaccctaaaaacggtaacgtaagggtaaaccctaaggggtaaacgtaacgggttaacttacgtaacgggttttgggaaccggtttaccgggtagggtaccgggaaccgtaacgggtttacctacggggtaaccccgttacggtaggtaccgaaccggttacccggaaccgtcgttacccggtcccccgtacccggg

SEQ ID NO: 202337 - DNA, 663 bp, Homo sapiens
  misc_feature: GYAE6OF02JC4AV.21.46.E02.1.454.CMB.1.raw
  modified_base (237)..(237): a, c, t, g, unknown or other
  misc_feature (237)..(237): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaaggggtgggtccaggaggcagaactctgggtgtctcaccatggcctggatccctctacttctcccctcctcactctctgcacaggctctgaggcctcctatgagctgacacagccacctcggtgtcagtgtccccaggacagacggccaggatcacctgctctgcagatggactgaccaaagaatntgcttattggtaccaacagaagccaggcccgaggcccctgtcgttagtgatactataagacactgagacggccctcgaganactcccngtacgcgtattcctcgtggactccagtctacgacgggtaccacgacctacgtccgtacgttagaaccgttactcaaggttacgacgttcccgaaggtcgaagggtaaccggacgggtacggacgttaccgttaacttacgtttaccgtacggtaaccaaacggtaacggtacgtaacgagttaacggagtttaacctgttaaacggtttggggcgtttaaccggggacgggtaacggggtaaccaaggttaccgttaccgggtacccggtaccggttagggtaccccgtaaccgggtacccgtaaacgggcccgttaccccggtaccccggttcccgg

SEQ ID NO: 202338 - DNA, 809 bp, Homo sapiens
  misc_feature: GYAE6OF02JAI77.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgaccacagccaccctcggtgtcagtgtccccaggacagacggccaggatcacctgctctgcagatggactgaccaaaagaaatatgtactttagttggtaaccaaacagaacgccgacggccacggtccccctgtgttagtagataataataaagacacgtagagacggccctagagagacttccagacgcgtacttctcgtcggcctccgagtccgtcggaacgggacacgaccaacgttccgtacggtttagacctttaacgtacgtaacggttacggaaacggttacccgtaagggaccgtaaacgggaaccgggtaacggaacgggtaccgttaacggtaaaccgtttaacgtttaaccgttacgtaacccgtaaaaacgtaacggttaaaaccggaaccgttaaagggttaacgggttaaaccgggtttaacccgttaacggttaacgggttttacgggggtttaacggggtttcccgggggtaccggggtaaaccggggggtaaacccctaacgggggttacccgtttaacccggggtaaccccggttttccccgggttaaaccgggttacccggtaacccgggtacccccggttaaaccggggtccccgttaccccgggtaccccccccggtttaacccgggg

SEQ ID NO: 202339 - DNA, 732 bp, Homo sapiens
  misc_feature: GYAE6OF02HSDXD.21.46.E02.1.454.CMB.1.raw
  modified_base (249)..(249): a, c, t, g, unknown or other
  misc_feature (249)..(249): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccacctgctctgacagatggactggaaccaaaagaaatntacgtactttattacggtaaccaaacgaggaaacgaccgaacgggacccgacggccccttagttcgttaagtagtagtaataataaacgacactgaggacgcctanagagactccgtagganacgtactctacgtcggcctaccgacgctacggaacggacacgacgtacgtacgtacgttacgacgttacgtacgaaggttacggaaacgttccggaacgggtacgaacggggtaaacgggtacgggtaaggtaccgtaacgtaacgttttaactaacgttacggttaaaccgaaaacggtaaggttaacgaaaccggtaaggtaaggttaacggttaacgttacggttaaagggtttcggggttacgggtaccggggaccggggtaaccgggaacgtaaccggtaccggtaacggaccccggttacgtaacggtaccgaccggaacccggtaacggcccgttacccggtccccgttaccgg

SEQ ID NO: 202340 - DNA, 788 bp, Homo sapiens
  misc_feature: GYAE6OF02H26MQ.21.46.E02.1.454.CMB.1.raw
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagatggactgacaaaagaatngtcttattggtacaacagagccaggccaggccccttgtgttagtgatataataaganacgtagagacggtcctcagacgactcccgtaggaacgtcgtacttcctcgtcggtctccgacgtccgttaccgaaggggtaaccacggccgtaacggtaccgtaaccggtttacgtaaccgttaacgttaccgtaaaggttaacgggtaaaccgttaccccgaaaggggaccgtaaaagggacggggtaaccggtaacggggtaccgttacgtaaacgtttaaacgtttaacgtacggttaaaccgtaaaaccgtaaaggtaaccggtaaacgaagggtttaacgggaacggtttaacgtaccggttaaaggtttacgggggttcgggtttaaccggggtaccggggtaaacggggtaaccggtaaaacggttcccgggtaaccgggttaaccccgggttaacccggtttaaccgggtacccgtaaccggggtaaccccggtaaaccgggttcccggttaccccggtaccccccggtttaacccgggg

SEQ ID NO: 202341 - DNA, 654 bp, Homo sapiens
  misc_feature: GYAE6OF02JY08E.21.46.E02.1.454.CMB.1.raw
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (381)..(381): a, c, t, g, unknown or other
  misc_feature (381)..(381): n is a, c, g, or t
tcagtcgtcgctcgcacgaccggtgctcgatttagactcatctacagggaaagggggtgggtccgaggaggcgagaactctgggtgtctcaccatggcctggatccctctacttctcccctcctcactctctgcacaggctctgaggcctcctatgagctgacacagccacctcggtgtcagtgtccccaggacagacgccaggatcgacctgctacgtgcagatggactgaccaaagaatatgtcttattacggtaacccaagagaagaccaggccaggcccctgtcgttagngaatntaataagacactgagacgccctgaagntactcccgtagaacgtgattccacgtgggccttccgaagcctagacggggtaacngacgtcgtactacggtttacgactacgtacgtaaggttacgaacgttaccgacggtaccgaagggaacggaacggacggtacgtacgtaacttaacgttactacgtaaccgaaagtagaacgtacgtaaacgtagacgtaacgttgtaacggttgggtacgggttaccggcgggtaacgggtaaccgaacggtaccgttaccggtacccggtaccgttacggtaaccgtaccggaccgtaaccgggacccgttaccggaccccccgttccggg

SEQ ID NO: 202342 - DNA, 699 bp, Homo sapiens
  misc_feature: GYAE6OF02GRKN7.21.46.E02.1.454.CMB.1.raw
  modified_base (240)..(240): a, c, t, g, unknown or other
  misc_feature (240)..(240): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacagtctctgaggcctcctatgagctgacacagccaccctcggtctcagtgtccccgggacaaacggccaggatcacctgctctggagatgcattgaccaaaaattntgtttttgaccagcagaagtcaggccaggcccctgtgttggtcatccatgaggacgaggacgaccgacccgtccgggactccccgtagagagtatttctcgtcggctccgaactacgacggggacggtggccgtacgttgactttcgtcgaggtcggggccccgagggtcgggagggtacgtaggaaacggtcgtaacggtaaccgttaaccgttaccgtttaggtttaaccgtcctaaggaccaacggtaaccgaacgcgtaaggtcggtaccgtagttaccgggaacgggggtctacgggttccggggaccgggaacggggaccgtacgggttcggaacccgtccgttacgggtccgaacggtaccccggaaggtcccgtacccggtcccccgttccgggttacccaccgttacccgtttcccggttacccccttaccccgtacccctttcccccgg

SEQ ID NO: 202343 - DNA, 655 bp, Homo sapiens
  misc_feature: GYAE6OF02HXMGG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtccagtgtccccaggacagaccggccaggatcactgctctgcagatggactgacctaaaagaatatagacttattcggtaaccaaacaagaagaccgaggccaaggccccctgtgttagtaggatattaactaaaagacaacgtgaacgaggaccctcaagacgactccctaggacgcgtacttctcgtaggctaccgagctacgagggacagcacgtcacgttagactatactagtacgaacgtcgaaggacaaggacggaacgaggtacgtagacgttaacgttactacgtaactaaacgacggtaacgaccgtaaggtaacggaacggttaacgttcgtaagttggggttacgggtttaccggacggggaacgggtaaccggaaacggttccgtaacggtaccccggttaacccgtacgggttacgaccggtaacccggtaacgggtcccgtaccggtccccccgttaaccggg

SEQ ID NO: 202344 - DNA, 714 bp, Homo sapiens
  misc_feature: GYAE6OF02FQ6IC.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgacttattggtaccaacagaagccgaggccacggcccctgtcgttagtgtatataataaagactacgtagagaccggtccctacgaagacgtacgtcccgtagacgacgtacttcctacgtcgtacctccgacgtccgtacggaacgggaccgacgtaccgacgtaccgtacgttacggtaaccttacgtaccgtaagggttaacgtaaccggtacccgaacgggacggaaagggtaacgggaaccgggaacgggtaccgtacggttaaccgtttaagttaccgttacgtaaaccaaaacggttagtaacgaacgtaagtaaacggtaacggtttaccgtaacgttaggtttcgggttacgggttaccggggagggtaaccgggaccgtaacggtccggttaaccggtacccgttacggttacggtacgaccggtacccggaacggtccggtaccccgtccccggttaccgg

SEQ ID NO: 202345 - DNA, 711 bp, Homo sapiens
  misc_feature: GYAE6OF02H59IL.21.46.E02.1.454.CMB.1.raw
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccaggacagacgccaggatcacctgctctgcagatggactgaccaaagaaatntgacttatggtaccaacagaagccaggccaggcccctgtgttagtgatatactaaagacactgagacggccctnagagatcccgtagagcgattcctacgtggctcccagctcgaacgggacagtcgacggtcacgttttagaaccttataccgaaggttacgaaacgttcccgaaagggcaacggagggtaaaccggaggtaccgtaggtaaccttaactttaacgtacggttaaaccaaaacggtaacgttaaacggacgtaaagggttaaggtaaacggggtttacctacggtaacggttttacgggggttagggttttaccggggaccggggtacggggtaacccgaaaacgggttaccttaacgggttaacccccgggttacccgtttaacggggtttaccgaaacccgggtacccccgtaaacgggggtaccccgtttaccgggacccccccccgtttaaccgggg

SEQ ID NO: 202346 - DNA, 693 bp, Homo sapiens
  misc_feature: GYAE6OF02G2MQM.21.46.E02.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcgacctgctctgcagatggactgaccaaaagaaatatgcttattacggtaccaacagaagccaggccaggcccctgtgttagtgatataataaagacactgagacggccctanagagactccctaggacgcgaatttccgtcgtggcctacgacgcttacggaagggaaccagaccgaagttccgtaaacgttcgtaactaacgttacgtaacggttagtaacggttacccaagggtaccgaaaggtaacgggaacggtaacgggtaccgttaacggtaacctttaagtttaaccgttacgggtaaacctaaaaccgtaaggttaagtaaaccgtaaggttaacggtaacggttaaccttacgtaggtttaggggttacgtttacggggacgggtaacgggaaccgtaaggtaccgtacggtaacccgttaccgtacggtacttaaccggacccgtaaaggtcccttacccggcccccgttacgg

SEQ ID NO: 202347 - DNA, 741 bp, Homo sapiens
  misc_feature: GYAE6OF02IHPJ7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctgaccacacgccctaccctcggtgtcgagtcgtcccaggacacggacgccgaggactcacctgctcgtcgcagagtcggactacgaaccaaaagtaatacgtcgtactttaagttacggtaaccgaaaccgaaggaacgaccgtacggacccggtaacggtcccccgttaggttaggttaaggtagaagtttaataaacgtaaaacgaacgtaacgttaggaaaccggtacggtacccgtttacgaaggaacgtacgtacccgtagacggtaccgtacgtttaaccgttcgtacggtacctaccgtaagccttaaggacgggactacgacgacgttacgtaacgttacggtactagtttcgaacgttacgaacgtaccggtacgacggtaacggacggtaacggtaggtaccgtacgtacttaaccgttacgtaagtaaccgtaaacgtaacgtaagaaccgtaagtacggtaacgtcgttaccggtaggtttcgggttaggttaccggtacgggaacggtaccgtacggaccgtacggtcccgtacgtacgtacgacggtccggaacgtcgtaccgccctacgg

SEQ ID NO: 202348 - DNA, 784 bp, Homo sapiens
  misc_feature: GYAE6OF02HGSFC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccgaggacaggaccggccaggatccacctgctctgcagagtggactgaccaaaagaaatatgactttagttcggtaaccaaacgaagaacgcccgaagggcccacgggtccccccgttagttacggtttagtaggtaacttaagtaaattaaaaaggaccgtaaccgttaggaacggtaaccgggaccccttacgaacggtaacggtaactcccccgttaggacgtacggttaaactttccgttacgtcggcccttaccgaacgtaccgttaccggaacgggaaccgacggccgtaacgttacccgtaacggttttacgaaccgtttaacgtaccgtaagggttaggtaaaccgttacccgagggaccgaagggaacgggaacgggtacggtacgttaacggtacctttaagttaaccgttacgtaacctaaaacgtaggttaaacggacgtaacggtaaggtaaccgttacgttacgtaggtttgggtacgggtttcgggacgggtaacggaccggtaacggtaccgtaggtaccccgttacgtaacggtccgacgacccggtaacggtcccgtacccgtccccggttacccgg

SEQ ID NO: 202349 - DNA, 645 bp, Homo sapiens
  misc_feature: GYAE6OF02JNBWV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggactcacctgctctgcagatggactcgaccaaaagaatatgtacttattgtaacccaagacgaagccgaacggccgacggtccccttgtagttacgtagtatataaagtaaacgactaacgtgaacgacggtacctcgaagagactcccgtagagtcgtacttcgtcgtcggcctaccagtccgtagaacgggtacgacgtacgtacgttaccgtaacgttgtaacctagttacgaaggtaacggtacgtccgaaggtcgaaggacggaccggaggtacctaggaacctttacttacgcgtaacgaaacaaggtacgacgtaaagtaggaacgttactacgtagttgggtcgttaggacgggacggacctaaggcttacgggaaccctcggttaacggacctacgggacctaacgggtcccttacccggcccgttacgg

SEQ ID NO: 202350 - DNA, 593 bp, Homo sapiens
  misc_feature: GYAE6OF02HIZ1Q.21.46.E02.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtacttattggtaaccaaacagaagccaggccaggcccctgtgttagtgaatataataaagacactgagacggcccanagagactccctagagcgtattctcgtggctccagctacgagggaccagcgtacgtctacgttagactatcgaagtagaacgtcgaggacaggaaggacggaggtctacgaacttacttactgtaaccaaacgtagtaacgacgtaggtaagtacggttactacgtagtttggggtacgttcgggacgggtacggaaccgaacggtcgtacggtacccggttccgtacggtaccgtacggacccgtaaggtccgtaccggtcccccgttccgg

SEQ ID NO: 202351 - DNA, 732 bp, Homo sapiens
  misc_feature: GYAE6OF02IJRWM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgactttagttacggtaaccaaacgaagaacgccgacggaccacggcccctgtacgttacgtagtataataagtaaaagaacacgtgaagacggccctacgaagacgtactcccgtaggacgacgtatttccgtacgtcggtcctaccgacgtcctaccgagggtaaccacggccgtaaaacgtccgtaacggtttagaaccttacgtacgaggttacgaacgttccgaacgggacgaagggaacgggtaacggaggtaccgttaagtaaccgtttaatttaacgtacgtaaaccgtaaaacgtaacggtaaggaacgtaaggtaaggtaacggttaaccttacgtaaggttttcgggtacggtttaccggggaccgggtaacgggtaccgtaaaggtaccgtacgggtaacccggttaccgttaacgggtccgtaaccgggtaccccggtaacgggtacccgttacccggtaccccccgttaccggg

SEQ ID NO: 202352 - DNA, 643 bp, Homo sapiens
  misc_feature: GYAE6OF02JN4NK.21.46.E02.1.454.CMB.1.raw
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
  modified_base (324)..(324): a, c, t, g, unknown or other
  misc_feature (324)..(324): n is a, c, g, or t
  modified_base (337)..(337): a, c, t, g, unknown or other
  misc_feature (337)..(337): n is a, c, g, or t
tcagtcgtcgctcgcacgaccggtgctcgatttagactcatctacagggaaagggggtgggtccgaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgccaaagaaatangcttatggtaccaacagaacgacaggccaggcccctgtgtacgtgatatataaagcactgagaggccctnacgagactcccngaagcgtaattcnttaggctccaagcctcgaagggactagcctaaggtccaacggtttcgtaacgtaatccgtaagtacggtaacgtaccgtaaacggtcgaacggtaacggacggaacggttacgtacgtaacgttacgttaaacgtcgtacgtaaaacgtaacggtaagaaacgtacggttaagtacggttaactcgtaagtttagggttaccgttacgggacgggtacgggaaccgaacggtaccgtacgggtacccgtaccgttagggtacctaacggacccggaacggtacccggtacgtccccccggttacgg

SEQ ID NO: 202353 - DNA, 537 bp, Homo sapiens
  misc_feature: GYAE6OF02GC7SU.21.46.E02.1.454.CMB.1.raw
  modified_base (257)..(257): a, c, t, g, unknown or other
  misc_feature (257)..(257): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgcagatggactgaccaaagaaatatgcttattggtaccaanagaagccagccaggcccctgtgttagtgatatataaagacatgagaggccctnagagactcccngacgcgattctcgtggctcagctcgaggacagcagtcacgttgactatcgagtgaacgtcgaggacaggaggacgaggtctagacttaattactgtaaccaaacgagtaacgaacgtagtaagaaggttactacgtagtttgggtgttacgggacggtagggaccgaagcgttacggaccgtccgtaggcacggaccgaggtcctcggcccctcgg

SEQ ID NO: 202354 - DNA, 647 bp, Homo sapiens
  misc_feature: GYAE6OF02F3A7P.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgcttattggtaccaacagaagccaggccaggcccctgtgttagtgatatataaagacactgagacggccctacagagactcccctagagcgtattctcgttggcctccgagcctacgacgggtacacgtcagtccacgttagaccttatccaggtagaacgtccgtaggctaaggacggtacgaggtctaggacttaattacgtgtaacaaaccgtagtaagaacgtaagtaacgtacgggttactaccgtagtttcggggttacggtttaccgggacgggtacgggaacccgtaacggtaccggttaccggaaccccgtttaccggtaacggggttacccgaaccgggtaacccccggtaaacgggtccccgttacccggtacccccccggtttaccccggg

SEQ ID NO: 202355 - DNA, 671 bp, Homo sapiens
  misc_feature: GYAE6OF02GDUQ1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccacctcggtgtcagtcgtccccaggacagacggcaggatcacctgctctgacagatggactgaccaaaagaaactatgacttattcggtaaccaacgagaagaccgacggccacggtacccccgtggttacgttaggtagtaataattaagttaaaacgacaacgtggaacgacggccctacgagacgacgtcccgtagtagctattcgtcgtcggctcccgagtaccgtcgaacgggacacgacgtacgtcgtacgttcgaacttacgtactagtacgtaagttcccaggacgtagaacggtacgaggtactacgtaacgttacgttaacgttacgtaaaccgaaacgttaggtaacgacgtaaggtaacggtaacgttacgtaaccgtaggtttacggggtagttaccggggtcgaacgggtacgaaacggtccgttacggaacccgttcgttaacggtacgaccggttacccgaaggtcccgttaccggccccgttaccggg

SEQ ID NO: 202356 - DNA, 742 bp, Homo sapiens
  misc_feature: GYAE6OF02JPJ6V.21.46.E02.1.454.CMB.1.raw
  modified_base (378)..(378): a, c, t, g, unknown or other
  misc_feature (378)..(378): n is a, c, g, or t
tcagtcgtcgctcgcacgaccggtgctcgatttagactcatctacagggaaaggggtgggtccgaggaggcagaactctgggtgtctcaccatggcctggatccctctacttctcccctcctcactctctgcacaggctctgaggcctctatgagctgacacagccacctcggtgtcagtcgtcccaggacagacggccaggactcacctgctcgtgcacgagtcggactcgaccaaaagtaaaattcgtgtaacttacgtttacggtaacccaagaagaacgaccgagggccccagggtacccccttggttaggttacggtagacttaagtaactaaaagaccacttaggaacggacggtcccctaagtaacggaanaccgttaccccgtaggaccgtacgtaacctttcgacgtttccgggaaccgtttcccgaaagggtcctaccggaggggaaaacctcggtacgtaaccggttctaaccgggttactaacgttcgtaaccgtaggtaaggtaacttcccggaaaggtcgaacgggacgaacggtacgacggtagtacgttaacgttacgttacgtaccgaaacgtaacgaacgtaaccgtggaacgacggttactcgtaaagttccgggttaggttcgggtacgggtaacgggtaaccggtaaggccgttaacggaccggttaccgtaacggtaccgtaccggacccgtagggtaacccgtcctccccggttaccgg

SEQ ID NO: 202357 - DNA, 784 bp, Homo sapiens
  misc_feature: GYAE6OF02IGCI0.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagccttcctatgagctgacacagcccaccctcggtgtcagtcgtccccaggacagacggccaggatcacctgctctgcagatggactgaccaaaagaatntgctttaatggtaaccaacagaagccaggccaggccctgtgtatgataatataaagacactgagacggtccctacgaagtaacgaacttcccgtaggagaccgtaatttcccgtcgttgggaccttcccgaagtccgtacgaagggggaaccagggtacctaaggttacccgtaacggtttagtaaccgttaagttacgtaacgggttacgtaaaacggttacccgaaagggacccgaaagggtaacggggaaaccgggtaaccgggtaccgttacgggaacctttaaacgtttaaaccgttacgtaaaccgtaaaaccgtaacgggtaaacggtaaaccgtaaggtaaacgggtaacggtttaaaccgttaccgtttaaacggttttcgggggtttagggtttacccggggacggggaaaccggggggtaacctaaacgggaccgttaacgggtaaccccgtttacccggaacggttcccgtaaacgggtacccccggtaaacgggtcccggttaccccggtccccccggttaacccggg

SEQ ID NO: 202358 - DNA, 775 bp, Homo sapiens
  misc_feature: GYAE6OF02F4817.21.46.E02.1.454.CMB.1.raw
  modified_base (594)..(594): a, c, t, g, unknown or other
  misc_feature (594)..(594): n is a, c, g, or t
tcagtcgtcgctcgcacgaccggtgctcgatttagactcatctacagggaaagggggtggggtccaggaggcagaactctgggtgtctcaccatggcctggatccctctacttcctccccctcctcactctctgcacaggctctagaggcctcctatgagctagacacacgcccaccctcggtgtcaggtcgtccccaggaccaggaccggccaggactccgacctgctcgtgacagtaagtcggactacggaaccaaaaggaaactatcggtactttaagttacggtaaacccaacgtaaggaacgacccgtaacggacccggaacggtcccccgttaggtttacggttacggtacgtaagttaagttaaacgtaaaaacggtaccaaccggttaggaaccgaacgggtaccccctagaaaacggtacgtaaccgttaacccccgtgggtaacggaccggttaactttacccgttcgacgggtcccttaccaggtcccggttacgaacggggtaacaacggtcacggtttaacctggtttaccgactaacgtacgtaaggtactaacggtccgaacgggacaagggtaccggnggtaacggcgtacgtaacttaacgttactaggtacaaacgtggtaagacgtacgtaaggacgtacctataggttgggtacggtaccggagggtaacggtaacgtacggtacgtacggtaacccggttagttaacggcctaaccggtacccgtaggtccccgttaccggaccccgtttacgg

SEQ ID NO: 202359 - DNA, 725 bp, Homo sapiens
  misc_feature: GYAE6OF02JB8QV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaaccaacagaagccaggccacggcccctgtgttagtgatatataaagacactgagacggccctagagagactacccgtagacgcgtacttcgtcgtacgggtcctaccgtagaccttacggaggggaacaggactaggtaccgtacgttcgaacttactacgtaagtacggtaaacgtcccgaacgggacgtaaggaacgggaacgtacgggtacctacggtaacctttaacgtttaaccgtacggtaaccgtaaaacgtacggttaaacggacgtaaagggttaaacggtaacggggtttaccttaaccggttaaggttttcgggggttaacgggtttaccgggggaccgggtaaacgggtaacccgaaacgggttacccggtacggtaaccccgggttaccgttaacggggtaacccgtaccgggaaccccgtaacgggtacccgtcccggtcccccccggtttaaccggg

SEQ ID NO: 202360 - DNA, 638 bp, Homo sapiens
  misc_feature: GYAE6OF02GJ63N.21.46.E02.1.454.CMB.1.raw
  modified_base (337)..(337): a, c, t, g, unknown or other
  misc_feature (337)..(337): n is a, c, g, or t
  modified_base (384)..(384): a, c, t, g, unknown or other
  misc_feature (384)..(384): n is a, c, g, or t
  modified_base (391)..(391): a, c, t, g, unknown or other
  misc_feature (391)..(391): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtcgtccccaggacagacggccaggatcacctgcctctgcagatggactgaccaaaagaaatatcgattattggtaaccaaacgagaagccaggcccaggcccctgtgttagtgataataagtaaagacactagaggacgcctcagagactccngacgcgattctcgtgcctcgagctacgaggacagctagtctacgttnaacttancagtagaacgtccaggtacgaggacggacggacggacgtagtaacgttagttaactacgtaacgaaactaggtaacgacgtaaggtaaggtaacggttaacgtaccgttaggtttacggggttacggttacgggacggggtaacggaaccggtaacgggtccgttaaccgggacccgttaccggtaccggtacgaacccggtacccggaaaccgggtcccgtacccgggtcccccccgttaaccggg

SEQ ID NO: 202361 - DNA, 716 bp, Homo sapiens
  misc_feature: GYAE6OF02IYV8V.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgcttaattcggtaaccaacagaacgccgaggccacggcccctgtgttagtgatataataaagacacgtgagacggccctagagagactccctgagcgtacttctcgtcggcctccgagcgttacgaacggggaccacggcgtaacgttccgtaacggtttacggaccttaatacgtaggttaggaacggtaccgagggacaagggaacgggacgggaggtcgttaggtaaccttaatttaaccgtacggtaacctaaaacggagttaacggaacgtaaggttaaacggtaacggttaaccgtttacggtaaggttttaggggttaccgggtttacgggggtaccggggtaaccggggaaaccgtaacggtaccggttaccgggtaaccccggtttacccggttaacgggtacccgtaccgggtaaccccgtaacggggtccccgtaccccggtacccccccggttaccggg

SEQ ID NO: 202362 - DNA, 696 bp, Homo sapiens
  misc_feature: GYAE6OF02IBBH7.21.46.E02.1.454.CMB.1.raw
  modified_base (391)..(391): a, c, t, g, unknown or other
  misc_feature (391)..(391): n is a, c, g, or t
tcagtcgtcgctcgcacgaccggtgctcgatttagactcatctacagggaaagggggtggtccaggaggcagaactctgggtgtctcaccatggcctggatccctctacttcctccccctctcactctctgcacaggctctgacggcctcctatgagctgacacacgcccacccgtcggtgtcagtccgtaccccagggacacggaccggccgaggactccacctgcctctgcagagtggactcgaacaaaagtaatctgtctttagttacggtaaccaacgagacgcgacgccgaccgcctgtagttgagataataataaacgacagtggacgaccggccctagagtacgtacctccgtaggacgcgttacttcgtcgtacgctacccgngcctacggacgggaactacggactacggtaccgtacgttagaacgtacgtacgaggttacgaccggtacgacgggacggaagggtacgggaaccggtacggacgtttacgtacgtttaacgttaacgttacggaaacgtaacggttaacgtaacgacgtaagggtaacggtaacgttacgtcgttaggttaggggttaccggttcgggacggggtaacggtaccgtaacggtccggtccggtaccggtaaccggtgtacccggaaccggtcccgtaacgggtccccttcccggtaccgttcccgg

SEQ ID NO: 202363 - DNA, 549 bp, Homo sapiens
  misc_feature: GYAE6OF02G0M9I.21.46.E02.1.454.CMB.1.raw
  modified_base (178)..(178): a, c, t, g, unknown or other
  misc_feature (178)..(178): n is a, c, g, or t
  modified_base (312)..(312): a, c, t, g, unknown or other
  misc_feature (312)..(312): n is a, c, g, or t
  modified_base (432)..(432): a, c, t, g, unknown or other
  misc_feature (432)..(432): n is a, c, g, or t
  modified_base (484)..(484): a, c, t, g, unknown or other
  misc_feature (484)..(484): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtntcagtcgtccccaggcagacggccaggatcacctgctctgcagatggactgccaaagaatatgcttattggtaccaacagaagccaggccaggcccctgtgttagtgatatataaagacactgagacggccctnagacgactccccgtgagcgacttcgtcgtcggcctccgagtctcgaaggggacagcagtccacgttgactatacagtagacgtccgaggcgaggaggacgaggctacgtactattacgtntacgaacagtacgacgtaagtagaacggtctacgtagttgggtcgttcgggnggacgggtacgaagccgtggacccgttccgtaggtaccgaggcccagggcctccgccccgtccgg

SEQ ID NO: 202364 - DNA, 697 bp, Homo sapiens
  misc_feature: GYAE6OF02IVVCR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacagcccaccctcggtgtcagtcgtccccaggacagacggccaggatccgacctgctctgcagatggactgaccaaaagtaaatatgtactttattacggtaaccaaacaagaacgacccgaggcccgacggtcccctgtcgttagtgatataataaagacagtagagacgccctacgagacgactccgtagtacgcgtacttcctacgtcggtacctccgaagtccgtacggaacgggtacacggtccgtaacgttccgtacgtttacgaactttagtacgtagttaggaacgtccgaaggtacgaagggtacgggacggacggtacgtacgttaacttagttaccgtagtaaaccaaagtaacggtaacgaacgtaaggtaacgtaacggtaacttggttaaacggttgggtttacgggttaccggggacggtaacggggaacccgtaaggtccggttacggtacccgttaccggtaacggtccgaaccgggtacccgacgggtcccgttaccccggtacccccgttcccgg

SEQ ID NO: 202365 - DNA, 689 bp, Homo sapiens
  misc_feature: GYAE6OF02J1RXJ.21.46.E02.1.454.CMB.1.raw
  modified_base (308)..(308): a, c, t, g, unknown or other
  misc_feature (308)..(308): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgaccacacgcccacccgtcgggtgtcaggtcgtccccgaggacagaccggccaggatccacctgctctgcagatcggactcgaccaaagaatatgtacttagttacggtaaccaacgacgaacgaccgacggccacggtttttccccnggtacgttagtagaatataataaacgacacgtaggacgacggtaccctacgaagacgtactcccgaggacgtacgtacttcgtacgtcggtacctcgagcctaggacgggacaggacgtacgtacgtacgttagactatacgtaggtacgaacggtacgaggcgaacgggtacgggtacggacggtacgttacgtaacgttacgttacgtaacgtaacaaaacggtagtaacgtaacgtaagttacggtaacggttaacttacggtaaggtttggggtacggtcggggacggggaacgtaaccgacgggtacctaccggtccggttacggtaccggtaccgtaccgacccgggtaggtcccgtacccggtccccgttacgg

SEQ ID NO: 202366 - DNA, 530 bp, Homo sapiens
  misc_feature: GYAE6OF02F02JJ.21.46.E02.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtgtcagtgtccccaggacagacggccaggatcacctgctctgcagatggactgaccaaaagaaatatgacttattcggtaaccaacagaagccaggccaggccccctgtgttagtgatatataaagacactgagagccctacagagactccctgagcgattctctggcctccagcctcgagggacagcgagtcacgttnactatcaagtgaacgtcaggcaggaggacgaggcgtagtactattacgtgtacaaacgtagtaagacgagttagaaggttactgtaggttgggtacgttcgggagagggaccagcgtacgaccgtcgtagcacgaccgagcctcgcccgtcgg

SEQ ID NO: 202367 - DNA, 674 bp, Homo sapiens
  misc_feature: GYAE6OF02HZJBZ.21.46.E02.1.454.CMB.1.raw
tcagtcgtcgctcgcacgaccggtgctcgatttagactcatctacagggaaaggggtgggtccgaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctcgacagatggactgaccaaaagaatatgtacttattggtaccaactagaagccaggccaggcccctgtgttagtgagtataataaagacaactgaacgacggcctacgagagacttccccgaggacgacgtattcctcgtgggccttccgaaggcctaccgacgggaacacgacgtaacgtccgtacggtttacgaacgttaacgtcgtaacggttagaaacggttacccgaagggaccgaaacggtagggtaaaccgggaaggtacgttacggtaacttaagtttaaccgtacgtaaacctaaacgtacgttaaacgtacggaagttaaggtaacgggttaacttacgtaggttacgggttcggttacgggagggttaacgggaacgaacgtcgtagtacccggttacgtaccggttcgaaccggtccgaaccggtcgtacccgtcccccgttacgg

SEQ ID NO: 202368 - DNA, 909 bp, Homo sapiens
  misc_feature: GYAE6OF02F8Z0E.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacagccctaccctcggtgtcagtcgtaccccgaggacaggaccggccaggatccaccgtgcctctgcgagtatcggactgaccaaaagaattatgtacttagttacggtaaccaaacaacggaacgccgaacggcccgaaccggtcccccgttaggttacggtttagtcggtaacttaattaataaaacgacacgtaggaacgacggtccctacgaacggacgtacttcccgtaggacgtcgtactttcctacgtcgggacctaccgacgtaccgtacggaacgggtaccgacggaccgtacggtttaaccgtacggtttaccggtaactttaccgtaacgtaacgggttaacggtaaaaccggttcccggaaacgggtaccggaaaacggggtaacgggggtaaacccgggtacgggtaaccgttacgggttaaaccgttttaaacgtttaccgttaaccggtttaaaccaaaaccggttaagggttaaaccggtaaccggtaaacgggtttaaagggtaaaccgggttttaaccgttaccggtttaaacgggtttacggggggtttaaccgggttaaccggggacgggggggtttaaaaccgggtaacccggaaacggggtttacccggttacgggttaaacccccgggtttaccggttaacgggttaacccgtaacccggggttaaccccggttaaaccgggtccccgttttacccccggggtaccccccgtttaacccgggg

SEQ ID NO: 202369 - DNA, 662 bp, Homo sapiens
  misc_feature: GYAE6OF02G2WR0.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgcagatggactgaccaaagaatngtactttagttacggtaaccaacgagaacgaccacggccaacggccccttggtacgtttagtcgtaattaataataaaacggacctaacgttaggaggtaccggcccgtacgaacgtaacgtactacccgtgacgacgtactttcgtcgtcggtacctccgagccgtagacgggacacgctagtccgtaagttcgactatcgaggtagaacgtccgaaggtcaggacggacggagtcgtagtacgttacgttactacgtaacaaacgtagttaacgacgtaaggtagtaacgttactacgtaggtttacgggttcggtacgggacgggacggtaaccgtaacggtaccgtaccggtaccggtaccggttaggtaccgaccggtaaccgtaccggtccggtacccgtccccggttacccgg

SEQ ID NO: 202370 - DNA, 605 bp, Homo sapiens
  misc_feature: GYAE6OF02HY89A.21.46.E02.1.454.CMB.1.raw
  modified_base (225)..(225): a, c, t, g, unknown or other
  misc_feature (225)..(225): n is a, c, g, or t
  modified_base (247)..(247): a, c, t, g, unknown or other
  misc_feature (247)..(247): n is a, c, g, or t
  modified_base (326)..(326): a, c, t, g, unknown or other
  misc_feature (326)..(326): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (531)..(531): a, c, t, g, unknown or other
  misc_feature (531)..(531): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacacgcccaccctcggtgtcagtcgtcccaggacagacggccaggactcaccgtgctctgcagngtggactacgacaaaagtaatntgacttagttacggtacaaacgagaacgccaggccacgccctgtgttagagatataataaagacagtgaagcggcctanagatacgtccgagagcgtattctcgtcgctcacgctacgacgggacngacngtactacgttagactactcgtacgtaacgacgtaccgtaaggaccgtaagggacgggacggacggtaccgtagtaaaccttagttaacgtacgaaccgtaagtaaacgtagaaccgaaggtacgagttaactgtaggttacgggttgtacgggnggaacggtacgaacgcgttaccgacgttacgtccggtacaaccggccgacggtccgtcccgtacccgtacccgg

SEQ ID NO: 202371 - DNA, 619 bp, Homo sapiens
  misc_feature: GYAE6OF02F2VP6.21.46.E02.1.454.CMB.1.raw
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
  modified_base (522)..(522): a, c, t, g, unknown or other
  misc_feature (522)..(522): n is a, c, g, or t
tcagtcgtcgctcgcacgaccggtgctcgatttagactcatctacagggaaagggggtgggtccgaggaggcagaactctgggtgtctcaccatggcctggatccctctacttctcccctcctcactctctgcacaggctctgaggcctcctatgagctgacacagccaccctcggtgtcaggtcgtaccccaggacagaccgggccaggatccacctgcctctgcagagtgactgaccaaaagaatattgctttatggaaccaagagaagccaggccaggtcccctgttcgtagtgatataanaagtacactgagacgccctnaanagactccgtagngtacgtagttctacgtcgtacnccaggtcctgaaacgggactacgctaacggtctaacggttagtacttacgtcgtagtacggtagtaccaggtacgaaggaggaccgaggctacgaagttactacgtgtactaaacgagtaagaacaggtagtaacggtaactgtaaagtttacgggggttntacgggtacgggaaggtaccgtaaacggcgttacggaccggttcgtaaccggtcgtaaggaccccgtaaggcccggttaccgtcccccgttaaccgg

SEQ ID NO: 202372 - DNA, 672 bp, Homo sapiens
  misc_feature: GYAE6OF02JDCJF.21.46.E02.1.454.CMB.1.raw
  modified_base (291)..(291): a, c, t, g, unknown or other
  misc_feature (291)..(291): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgcttattggtaaccaacgagaagccaggccacggccctgtacgttagngataataagtaaagacacgtgaagacggccctgaagagactcccgtagacgcgtatttccgtcgtggcctcgagtcctacggacgggacacggaccgacgttaccgtacgttagaaccttacgtacgtaggttacgtaaacggttcccgaagggtaccgaaggggaaccgggtacggaacggtccgtaacggtaacttaacgtttaacgtacggtaaacgaaaacgttaggtaacgaacgtaaggttaacggtaacggttaacttagtacggtttggggttaccgttacggggacggaacgggtaccgtaacggtcgtacggtaccgttacgtacggtaccgacgtacccggaacggtcccgtacccggtccccgttacgg

SEQ ID NO: 202373 - DNA, 647 bp, Homo sapiens
  misc_feature: GYAE6OF02GL4NL.21.46.E02.1.454.CMB.1.raw
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggactcacctgctctgcagatggactgaccaaaagtaatntgtacttattcggtaaccaanagaacgaccgacggccaacggtcccctggtacgttagtgaataataataaagacacgtagaggacgccctagaagacgactccgtagacgtcgtacttcgtcgtcggacctaccgagtcctacggaagggtaaccaggaccgtaaggttaccgtaacggtttacgaaccttaacgtaccgtaaggttacggaacggttccgaaggacgaaggacggacggacggtcgtacgtacttaagttacgtagtaaccaaagtagtacgacgtagtagtacgtactagtagttcgggttagtaccgggaggtacggaccgaaggtcgtaccggtaccgtcgtacggtaccacggtacccgaacggtcctcccggtaccccgtccgg

SEQ ID NO: 202374 - DNA, 538 bp, Homo sapiens
  misc_feature: GYAE6OF02FYNQ6.21.46.E02.1.454.CMB.1.raw
  modified_base (372)..(372): a, c, t, g, unknown or other
  misc_feature (372)..(372): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccaggccccctgtgttagtgatatataaaagacatgagaggccctcagagatccccgtgagcgattctctggctccagctcagggacagcagtcacgttgactancagtgaagtccaggcagaggacgaggctgactattactgtacaaacagtagacagtagagtagtctagttgggtgttcgggcggacggggaaccaaggtactcggaacccggttccgtaagggtccgaacggccccgaaaggcccgtccgtaccccccgttccggg

SEQ ID NO: 202375 - DNA, 729 bp, Homo sapiens
  misc_feature: GYAE6OF02I46IX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgcagatggacctgaccaaaagaatatgtacttagttcggtaaccaacagaacgccgacggccacggcccctgtacggttagtcgtaattaataagtaaacgacacgtaggaagacggccctacgagagactcccgtagacgcgtattccgtacgtcggtcctccgagtctacgaacgggaccacgcgtagttaccgtacgttacgtacttactacgtaggtacgtaacgtccgaaggtacgaacgggacgggaacggtacggacgttacgtaacgtttaacttacgtacgtaaccgaaaacgtaggtaaccggaacgtaacgtaacgggttaacggttaccttacggttaacggttttcggggttaacgggtttaccggggacgggtaaaccggggttaaccgtaacggggtaccgtttaccgggttaacccggttaccggtaaccgggttaccgaacccgggtaacccggtaacgggtccccgtaccccggttcccccgtttacccggg

SEQ ID NO: 202376 - DNA, 785 bp, Homo sapiens
  misc_feature: GYAE6OF02IB3PR.21.46.E02.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgacggcctcctatgagctgacacacgccacccgtcggtntccagttcgaccccaggacacggaccggccaaggactccaccgttgcttcgtgacagagtggactcgacctaaaagaattcgtgtacttagttacggtaaccaaacgaagaacgaccgacggaccgaacggtccccgttggttacgttacggtataacttaagttaaacgtaaaacgtaacctaacgtcggaacggtaccggtaccccgttacgaaggtaaccgtaccgtttaccccgtaggaccgacgttaacgtttccgttaccggtcggaccttaccgagtaccgaccggtacgggaacacggacgtacgttacgtacggtttacaacgttacgtacgtaacggtagtaaccgttcgaacggacgaacggtagggacggacggttaccgttgtaaacgttacgtttaacgtacgtaaaccgtaagttaacgggtagaaccgttaaggggttacgaacgtttaccgttagttaccgggtttagggttaccgggttccgggacgggaaccgggtaaccgaaacggttccggtaccggtacccggttacggacggttaccggaccgtacccggtaggtcccgttcccggtacccgtttaacccgg

SEQ ID NO: 202377 - DNA, 979 bp, Homo sapiens
  misc_feature: GYAE6OF02IX0TQ.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctccccctcctcactctctgcacaggctctgaggcctcctatgagctgacacagccacctcggtgtcagtcgtcccaggacagacggccaggatcacctgctctgcagatcggactcgaaccaaaagaaatagtcgtactttaagttacggtaaacccaaacgaacggtaaacgaccccgaacgggaccccgaacccgggtcccccgttaggttacggtttaagttacggtaaactttaagttaaagttaaaaaacggaaccgtaaccgttagggaaacgggtaaccgggtaccccccttaaggaaacggtaacggtaacctttcccccgtagggtaacggtaccgttaacttttcccgtcgtttaccgggtacccttacccggtaacggtacccgttacggaaacgggggtaactaacggaccggttaaacggtttacccgttaacgggttttacgtaaacccgttaacttacccggtaaagggtttacgggtaaaacccggttacccggaaagggtacccgtaaacggggaacggggtaaacccgggtaagggttacccgttaagggttaaccctttaaacggttttaacccgttaacgtaaaacccgttaaaaacggtaccgggttaaacggtaaaccgtttaaaggggttaaacggttaaaccggtttaacccgttaacggttaaacgggtttttagggggttaccggggtttacccggggtaacgggggtaaaccgggtaaacccggtaacgggtaacccggtttaaccggggttaaccccgtttaccgggtttaacgggacccgttaacccgggaaccccgttaacgggtcccgttaccccccggtaacccccgttcccggg

SEQ ID NO: 202378 - DNA, 665 bp, Homo sapiens
  misc_feature: GYAE6OF02JM0ZW.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgacttattacggtaaccaacgagaacgccacggaccacggtcccctggttcgttagtgataatataaacgacacgtgaacgacggtccctagaagagtactccgtagacgtcgtacttcgtctacggctaccgacgcgtacgacgggacacgactacgtactacggttgtaactatcgaagtgtaacgtccgaggtacgtacggaacggacggaggtactacgtaacttagttaaccgtagtaacccgaaagtacgtacgaaccgtaggtaacggtaacggttactacgtaggtttacggggtcggtttacgggacgggtaacgggaccgtaacgggtcgttaacccggtaccggttacccgtaagggttcccgaaccgggttccccgaaacgggtcccgttacccggaccccccgtttacgg

SEQ ID NO: 202379 - DNA, 807 bp, Homo sapiens
  misc_feature: GYAE6OF02IH7Y8.21.46.E02.1.454.CMB.1.raw
  modified_base (252)..(252): a, c, t, g, unknown or other
  misc_feature (252)..(252): n is a, c, g, or t
  modified_base (271)..(271): a, c, t, g, unknown or other
  misc_feature (271)..(271): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtaccccaggacacggacggccaggactccacctgctctgcagatggactacgaccaaaagtaatgtnacttattacggtaaccaanagaacgaccacggaccgacggcccctaggtcggttacgtagtaactaactaagtaaagacctacgtaggacggaccggtcctacgaagacgtacctccgtaggacgaccggttactttccgtaccgttggtaccctaccgtacgtaccgtacggtaacgggtaccgaacggcgtaacggttccgtaaccggtttacgtaaccttacgtaccggtagttaacggtaaaccggtaccgaacgggtacggaacgggtacgggtaaccggtagggtaccgtttaacggtaaccgtttaacgtttaaaccgtttaagtaaaccgtaaacgtaaaggttaaacgggtacgtaaaggttaacgggtttaaccgggttaaccttacggttaaacgggttttacggggttacggtttaccgggggacgggtaacgggtaacccgaaggtacccggttaaccgggtaccccggttttacggaaccggttacggaaccggtaccccggttaacggtccccggttaccccgtacccccggttacccgg

SEQ ID NO: 202380 - DNA, 536 bp, Homo sapiens
  misc_feature: GYAE6OF02FHRE2.21.46.E02.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtcccccagggaccagacggccaggatcacctgctctgcagatggactgaccaaagaaatatgcttattggtaccaacagaagccaggccaggccccctgtgttagtgatatataaagacactgagaggccctnagagactccctgagcgattctctggcctccagctcgagggacagcagtcacgttgactatcagtgaacgtccaggcaggaggacgaggctggactagttactgtaccaaacagtaagacagttagaggtactctagttgggtgttcgggcggtagggaccaaaggctacggacccgttcctaggttcacggacccgaggtcctcggcccccgttcgg

SEQ ID NO: 202381 - DNA, 595 bp, Homo sapiens
  misc_feature: GYAE6OF02GXGOM.21.46.E02.1.454.CMB.1.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (320)..(320): a, c, t, g, unknown or other
  misc_feature (320)..(320): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatntgcttattggtaaccaanagaagccaggccaggcccctgtgttagtgatataataaagacactagagacggaccctnaagagactaccccgtgacgcgtaatttctacgtgctcagctacgaggacagcagtcagttagactatcagtacgaacgtcagganaggacgacgngctagactaagttacgtagtacaaacgagttaacgaaacgagttaagagtaacgttcgtaggttcgggttagttaccgggacgggaacggtaaccgaacggtacgtacggtaacccgttaccgttaacggtacgtaccggtacccgaacgggtccgttacccggacccccgtttacccgg

SEQ ID NO: 202382 - DNA, 559 bp, Homo sapiens
  misc_feature: GYAE6OF02GTQCP.21.46.E02.1.454.CMB.1.raw
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgcttattggtaaccaacgagaagccaggccaggcccctgtcgttagtgatataataaagacactgagacggccctanagagactccctgagcgtattctactggcctacagctcgacgggacagcagtcgtacgttacgactactacagtagacgtcgaggacgaggacggacgaggtcgtagtactattacgtagtactaacgagtaagacgtagtagtagtacgtacgtagttgggtggtcggacggacggacgtttttaacgacgtacgaccgtaccgtacggtcgacgaccgacggcgtccgcccgtccgg

SEQ ID NO: 202383 - DNA, 739 bp, Homo sapiens
  misc_feature: GYAE6OF02HO917.21.46.E02.1.454.CMB.1.raw
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtntcagtcgcccaggacagacgcaggntcactgctntgcagatcggactgacaaaagaatntagtacttagttacggtaaccaaagaagacgaccaggaccacggtcccctggttagttaagngtaattaagttaanaaaacggtaccacgttagaacgaccggtccctagaagtacgacgttacccgagtacgacgtacttcctacgtcgaccttcgagtccgtacgacggggaactcgactcggttacgtaccggttagtaacttacgtacgtaacgtcggtaaacgtccggtaaggacgaggaagggacgacgggacgttacgaacgttacttaacgtacgtaacgtaaagtacggtaagtaacgtaaacggttaacggtaacggtttaaccgttaacggttagggttacggggtttacgggttaaccggggtacggggtaaacggggtaaccggtaaacgggtccggttaaccgggttaacccggtacccggttaacgggtaccgtaaccggtaacccgggtaaccggtcccggttacccggtaccccccggtttaccgg

SEQ ID NO: 202384 - DNA, 701 bp, Homo sapiens
  misc_feature: GYAE6OF02IDV8J.21.46.E02.1.454.CMB.1.raw
  modified_base (163)..(163): a, c, t, g, unknown or other
  misc_feature (163)..(163): n is a, c, g, or t
  modified_base (224)..(224): a, c, t, g, unknown or other
  misc_feature (224)..(224): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggcctctatgagctgacacngccacccgtcggtgtcaggtcgtccccaggacaggaccggcaggactcacctgcttctgcngatggactgacaaaagtaatatgactttatacggtaaccaacgagaacgccgaacggccacggtaccccttggttacgtttaaggtgaattaacttaaagtaaaacgacgtaccgtggacgacgggtccctacgaagtacgacttcccgtaggaacgcgtaatttcctcgtcggtcctaccgagtaccgtacggaacggggaacacggcgtacggttcgtaacggtttcgaacttagtaccgtaggtagtaaacggtcgaagacgggtaaggacggaacggtaacggtactacggaacttacgtttactacggtaaacaaagtcggtaacgacggtaaggtaacaggtaaacttaacgtcggtaagtttcggggttaggttccgggaacgggtacggaaccgacggtcgtaaccgggtacccgttacggtacggttaccgaacggtaccccgaagggtccctcccggttacccccgg

SEQ ID NO: 202385 - DNA, 515 bp, Homo sapiens
  misc_feature: GYAE6OF02IOY57.21.46.E02.1.454.CMB.1.raw
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
  modified_base (323)..(323): a, c, t, g, unknown or other
  misc_feature (323)..(323): n is a, c, g, or t
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (415)..(415): a, c, t, g, unknown or other
  misc_feature (415)..(415): n is a, c, g, or t
  modified_base (456)..(456): a, c, t, g, unknown or other
  misc_feature (456)..(456): n is a, c, g, or t
  modified_base (476)..(476): a, c, t, g, unknown or other
  misc_feature (476)..(476): n is a, c, g, or t
  modified_base (508)..(508): a, c, t, g, unknown or other
  misc_feature (508)..(508): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtcgtccccaggaccagaccggccaggatcacctgctctgcagtatggactcgaccaaaagaaatntgacttagttcggtaaccaanagaagccaggccacggcccctgtgttagtgatatataagacactgagacgcctnagagctcctgacgcgtattctctggcctccganctcgagggacngacagtccgacgttagactactacgagtagaacgtcgagcagagacgngcgtagactattacgtgaccaagatagacagtagagtactnagttggtgtcgcggagacgngctcgaccgtgtacgcacgaccgaggcgtccncccgtcg

SEQ ID NO: 202386 - DNA, 710 bp, Homo sapiens
  misc_feature: GYAE6OF02JYKTC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccagggatccacctgactctgcagagtgggactggaaccaaaagtaatatgtacttagttggtaaccaactagaacgccacggccacggcccctgtgttagtgaactatataaagacacgtgagacggccctacgtagacgtactccgtagacgtcgactttctcgtcggacctaccgacgcgtacggaagggacagacgtagtacgtacgttaggactatccgtaggtacgaacgtaccggacggtacgaacgggtacgggtaacggagggtacgttacggaacgtttaaccgttaacggttacggtaaccgtaaaacgtaacggtttacgaaccgtaagggtaacgggtaacgttaacggtacgttacggtttacggggttcgttacggggtacgggaacgggtaaccggtaacggtaccggttcggtaacccggttaccggtaacgggttacccggtaccggaaccggtaacggtccggtaccccggtaccccggttaccccggg

SEQ ID NO: 202387 - DNA, 612 bp, Homo sapiens
  misc_feature: GYAE6OF02IPP1U.21.46.E02.1.454.CMB.1.raw
  modified_base (479)..(479): a, c, t, g, unknown or other
  misc_feature (479)..(479): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatatgacttattcggtaaccaacagaagccaggccacggcccctgtgttagtgatatataaagacactgagacggccctacagagactcctagacgcgattccgtctcggcctccgagtcctacggaacgggacacggacacgttcgaacgtttcgaacttaagtcgaagttacgaacgtccagggtaccaaggagggacgaggcgttacgaacttagttacgtgaacaaacgagtaanacgaagtacgagttactagtaggttgggtaggttacggacgggacggtaccgaaggtccgtaacggtacccgttccgtaacggtccgacggaaccccggtaaggtacccgtcccggtaccccccggttaccgg

SEQ ID NO: 202388 - DNA, 598 bp, Homo sapiens
  misc_feature: GYAE6OF02GMT0C.21.46.E02.1.454.CMB.1.raw
  modified_base (265)..(265): a, c, t, g, unknown or other
  misc_feature (265)..(265): n is a, c, g, or t
  modified_base (304)..(304): a, c, t, g, unknown or other
  misc_feature (304)..(304): n is a, c, g, or t
  modified_base (328)..(328): a, c, t, g, unknown or other
  misc_feature (328)..(328): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgtcttagttaggtaaccaanagaacgccgaggccacggcccctgtgttagtgatataanaaagactataggagacggccctanagacgactcccgtagacgcgtattacgtcgtcggccttaccgacgtcctacgaacgggacaggctaacgtccgtaacgttgaacctaatcgtaaggtacgtaacgtaccgaggcaaggacggacgaggctagacttatacgtatacaacgagtagacgagtagagttactacgtagttgggtgttcgggacgggtacggaaccgtaaggtccgtacggacccgttacgtacggtacacggacccgtaggccgtacccgccccgttaccgg

SEQ ID NO: 202389 - DNA, 670 bp, Homo sapiens
  misc_feature: GYAE6OF02JP0LL.21.46.E02.1.454.CMB.1.raw
tcagtcgtcgctcgcacgaccggtgctcgatttagactcatctacagggaaagggggtgggtccaggaggcagagctctgggaatctcaccatggcctggaccctctcctgctcccctcctcactttctgcacagtctctgaggcctcctatgagctgacacagccaccctcggtgtcagtcgtcccaggacaaacggccaggctcacctgctcgtggagtatttcattcgaaccaaaaagtattacttacgttggttcggttacccagcaagaacgtcgacggaccacggcccctgtacgtggtcatccagtcgacgaccagtcgaacgacgaccgtaccgggactcccgtgacgtagtacttcgtctcgccctcgacgtcgtacgacgggtacacggtcgacccttaccgttagactacgtcgacgggtccgggaccgtagggtacggaacgtagtacggaacgtacgttacgtaaccttacgttaacgtttacggttaccaccgtaacgacgtaacgtaggttacggttcgtacgtacggtcggtaacgggggttacgttcgggacgggtaaccggacgtacgttcggaccgttacgtcggtacgacgtacccggacgtccgtccgtccccgttacggtcctaccgtcgttacccgtcccgtacccg

SEQ ID NO: 202390 - DNA, 666 bp, Homo sapiens
  misc_feature: GYAE6OF02FXMS2.21.46.E02.1.454.CMB.1.raw
  modified_base (261)..(261): a, c, t, g, unknown or other
  misc_feature (261)..(261): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgtcttattggtaaccaanagaagccaggccaggcccctgtgttagtgaatataataaagacactaggacgacggccctacaggaacgtacctcccgtaggacgtcgtacttaccttcgtacggtcctcgacggtcctacggaacggggaccagaccgtagtaccgtacgttagacttataccgaggtacgaaacggttcccaagggtaccgaagggacgggacggtacggcgtacgtaacgtttaacgttacgtacgtaaacgaaacgtacggtaagaaccgtaaggttaaggtaacgtttactaacggttaggtttacggggttgttaccggggacgggtacggaaccggtagtaccggtacggtccgttacccggtagtaccgacggtaccccggaggtcctccccggcccgttacccggg

SEQ ID NO: 202391 - DNA, 529 bp, Homo sapiens
  misc_feature: GYAE6OF02HGRUU.21.46.E02.1.454.CMB.1.raw
  modified_base (430)..(430): a, c, t, g, unknown or other
  misc_feature (430)..(430): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgccaaaagaaatatgcttattcggtaacaacagaagccaggccaggccccctgtcgttagtgatataataaaagacactgagaggccctacgagagactccctgagcgtattctctggcctccgagctcgaggcagcagtcagttgactatcagtgaagtcaggcagaggacgagctgactatacgtagtacaaacagtanacgagtagagtactactagttgggtgttcggcgggtagggaccgaaggaccgtggacccgtcgtaggtcacggacccgaaggcctcggcccccgtacgg

SEQ ID NO: 202392 - DNA, 615 bp, Homo sapiens
  misc_feature: GYAE6OF02G74KH.21.46.E02.1.454.CMB.1.raw
  modified_base (243)..(243): a, c, t, g, unknown or other
  misc_feature (243)..(243): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggcagacggccaggatcacctgctctgcagatggactcgaccaaagaaactangtcttagttcggtaaccaacagtaacgccgaggccacggccccttgtcgttacgtgattataataaagaccactggacgacgccctanacgatntccctgacgtcgtattctcgtaggcctacagctcgacggacngacagtcacgttnactatcagtagacgtccagcgagacggtacgacggttacgtagtaacttagttaacgtagtaaccaaacgtagtaacggacgtaagtaaggtacggttacttcgtaggttacgggttcgggtttacgggcgggtaacgggtacgtaacggtccgtaggtacccggtaccgttaacggtcgtaccggacccgtaaggtcccgttaccggtcccccggttaccgg

SEQ ID NO: 202393 - DNA, 569 bp, Homo sapiens
  misc_feature: GYAE6OF02HGPQY.21.46.E02.1.454.CMB.1.raw
  modified_base (260)..(260): a, c, t, g, unknown or other
  misc_feature (260)..(260): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgcagatggactgaccaaaagaatatgcttattggtaaccaanagaagccaggccaggcccctgtgttagtgatatataaagcatgagacggccctgagagactccctagacgcgtattcctcgtggcctccagcctacgagggacagcagtcacgttgactatcaagtgaacgtcgaggacaggaggacgaggctagacttagttactagtaacaaacgagtaacgacgaaggtagtagttactcgtagttgggtgttacgggacggacgggaaccgaaggtccgtacggtaacccgttaccgtaggtaccgacggacccgtaaggcccgttacccggcccccgttaccgg

SEQ ID NO: 202394 - DNA, 560 bp, Homo sapiens
  misc_feature: GYAE6OF02JECLW.21.46.E02.1.454.CMB.1.raw
  modified_base (209)..(209): a, c, t, g, unknown or other
  misc_feature (209)..(209): n is a, c, g, or t
  modified_base (258)..(258): a, c, t, g, unknown or other
  misc_feature (258)..(258): n is a, c, g, or t
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (367)..(367): a, c, t, g, unknown or other
  misc_feature (367)..(367): n is a, c, g, or t
  modified_base (425)..(425): a, c, t, g, unknown or other
  misc_feature (425)..(425): n is a, c, g, or t
tcagtcgtcgctcgcacgaccggtgctcgatttagactcatctacagggaaagggggtagggtccgaggaggcgagaactactgggtgtctcaccatggcctggatcctctacttctccccctcctccactctctgcacaggctctgaggcctcctatgagctgacacagccaccctcggtgtcagtgtcccaggcagacggccaggancacctgctctgcagatggactgccaaagaaatatgcttattggacaacngaagccagccacggcccctgtgttagtagntaatataaaagacactgagacggcctacagagatcccngagcattcnctgcctcagctgagggacagcacgtcacgttnaactactcagtacgagtcgagcgaagaggacgaggctagactatttactagtacaaanagtaacgacgaagtaggaacggttatacggtattaggggtcgttacgggtccgggaaggaacgaacggactacggaccgttacccgtaagggttccaccgtacccgtaacgggaccgttccggacccccttcggg

SEQ ID NO: 202395 - DNA, 581 bp, Homo sapiens
  misc_feature: GYAE6OF02JLOXX.21.46.E02.1.454.CMB.1.raw
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (456)..(456): a, c, t, g, unknown or other
  misc_feature (456)..(456): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtacagtgtccccaggacaggaccgccaggactccaccgtgctctgccagtancggactcgaccaaagaaatntgcttattgtacaanagacgcagccacgcccngtgtgtgagtataataagacagtagacgacggccctagagagactacccgagacgcgtatcctcgtgcctaccgagtcctagacggtaccagactacgtacgtacgttagacgttactcgtaagtagtaacggtccgtaggacgaggaacggagaggtctacgtacttaagttntactactaaacgagtaactacgagtaagtaagtacttagtagttggtcgttaggcggtaggaccgagtacgcgtaaccggtctaaggtccgacggaccaccggtaccgtaccgtcccccgtacgg

SEQ ID NO: 202396 - DNA, 690 bp, Homo sapiens
  misc_feature: GYAE6OF02HVKON.21.46.E02.1.454.CMB.1.raw
  modified_base (182)..(182): a, c, t, g, unknown or other
  misc_feature (182)..(182): n is a, c, g, or t
  modified_base (268)..(268): a, c, t, g, unknown or other
  misc_feature (268)..(268): n is a, c, g, or t
  modified_base (449)..(449): a, c, t, g, unknown or other
  misc_feature (449)..(449): n is a, c, g, or t
tcagtcgtcgctcgcacgaccggtgctcgatttagactcatctacagggaaagggggtgggtccaggaggcagaactctgggtgtctcaccatggcctggatccctctacttcctccccctctcactctctgcacaggctctgagcctcctatgagctagaccacacgcccaccctcgggtntacctagtcgtacccccgaagggacgaggaccggccagggatccaacgtgctctgacagattggactcggaaccaaaagaattacngtacttagttacggtaaccaaacgaagacgaccgacggccaaccggtccctgttagttagagtaattaataactaaacgactaacgtaggaagaccggccctagaagacgactccgtgagcgtactctcgtacgtcctacgactcgtacggaggaacagaccgtacggtaccttacggttntaactacgtcgaggttacgaacgtcgaacggacgtaggaagggtacggaacgtacgttacgacgttttaacgttaacgtaacggtaaaccaaagtaacggtaacgtaaacggtaggttaaacggtacgttacgttaagtaggtttacgggttacgttcgggacggacggtacggtaacgtcgacggtaaccgtcgtacggtacaaccggtaccggaacgtccgtcccggtaccccttacgg

SEQ ID NO: 202397 - DNA, 628 bp, Homo sapiens
  misc_feature: GYAE6OF02HGOLG.21.46.E02.1.454.CMB.1.raw
  modified_base (176)..(176): a, c, t, g, unknown or other
  misc_feature (176)..(176): n is a, c, g, or t
  modified_base (387)..(387): a, c, t, g, unknown or other
  misc_feature (387)..(387): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccacctcggtntcagtcgtccccaggacagacggccaggactcacctgctctgcagatcggactcgaccaaagaaatgtgtactttagttacggtaaccaaacgaagaacgccgaaggcccacggccccttaggtgttacgtagactataataaacgactaactggaagacggccctacgaggatactcctaggacgcgtaacttctacgtgtcctcagtcncggaaggtacacgcgaacgtctaagttcgtactagtcaacgtaggaactcgaagcgaaggacggaggtggactgtaacgttactaacgtacgtactaaaagacggtaacgaacgtaaggtaacgacgttagtacgttaggttgggtacgggttcggacggtacgggtaaccgtaacggccgttaggaacccgttcggtacgtacgtaccggacccgacggtccgtacccgcccggttaccg

SEQ ID NO: 202398 - DNA, 731 bp, Homo sapiens
  misc_feature: GYAE6OF02HQWKA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaaacggccaggatcacctgctctggagtattcattcgaccaaaaagatatacttgttggttccagcagaagtcacggccacggcccctgtacgtggtcactccatggacggccaggtccgacgacaccgtccgggactcccgtgagtagtacttcctcgtcgccctcgacgctacggacgggactacgggtcggacccttaccgttacgaaccttagtcgtacgggtccggggaccccgtaggggtacggacgtagtacggaagtcgtacgtaaccttacgttaagtttacggttaccgaccgtaaccgtaacggtaaccgtaagggttacggttacgggtacctacggtaccggggttaagggggtttacggttaccgggggaacggggtaacgggtaaacccgttaagggttccggtaccccggttcggtttaccgggaccgtaaccgggtacccgtaacgggtcccgtacccggtaccccccggttcggtacccgttacccggttcccgttcccggttacccccgttcccccg

SEQ ID NO: 202399 - DNA, 786 bp, Homo sapiens
  misc_feature: GYAE6OF02JYAJX.21.46.E02.1.454.CMB.1.raw
tcagtcgtcgctcgcacgaccggtgctcgatttagactcatctacaggaaaggggtggtccaggaggcagaactctggtgtctcaccatggcctggatccctctacttctcccctcctcactctctgcacaggctctgaggcctcctagtgagctgacacagccaccgtggtgtccagtcgtccccgaggacagaccgcaggatcgacctgctctgcagagtcggactcgaccaaagtaaatgtgtacttaacttcggtaaccaacgagaaacgccgacggccgtaaggcccccgtgtcgttagtacgattactaattaaaacggacacgtagacgtacggaccctacgaggaacgtaccttacccgtaggacggtacgtaactttccgttcgtacggaccttacccgacgtccgtacggtacgggtaaccgaacggtactacggttaccgtacggttacggtaaacttacgtaccgtaaggtaacggtaaaccggttaccggaacgggacgtaacgggaacggaacggtacggtacgttaacggtaaccttaagtttaaccgttacggtaaccgtaaacgtaacggtaacgtaacgtaaacgggttaacggaaccggtttaacgtaaccggttaaagggtttcggggttacggtttaccggggtacgggaaccggggtaaccgtaaacgggtcttaaccgggttaaccccgttcggtaaccggttaaccggaccggtaaccccggtaaggtcccgttaccccggttaccccccggttaacccggg

SEQ ID NO: 202400 - DNA, 668 bp, Homo sapiens
  misc_feature: GYAE6OF02IIMRQ.21.46.E02.1.454.CMB.1.raw
  modified_base (206)..(206): a, c, t, g, unknown or other
  misc_feature (206)..(206): n is a, c, g, or t
  modified_base (326)..(326): a, c, t, g, unknown or other
  misc_feature (326)..(326): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggntcacctgctctgcagatcgactgaccaaagaatatgtacttattacggtaccaacagaacgccaggaccacggcccctgtcgttagtacgtatataataaagacactgacgcgtaccctnaagacgactcccgagacgacgtactttcctagttcggcctaccacggtcttaaccggagggaacacggtaccaaggttccgtaacggttttacgaaccgtttagtaaccctagggttacgggtaaaccgttccggaaacgggacgtagggaacggtaacggacggtactaggtaaccttacgtaactcgaactaaacgagtaagacgtagaaggtacgttacgacgttaaggttgggttacgtccggggaggtaaccgggaacctaaggtaccgtcgggtaacccgttcgtaagggtccgaaccgtacccgaagggtccctacccggtacccccggttacgg

SEQ ID NO: 202401 - DNA, 816 bp, Homo sapiens
  misc_feature: GYAE6OF02HVKDX.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctctgacggcctcctatgagctgaccacacgcccacccgttcggtgtcagtccgtccccgagggaccaggaccggccaaggctaccaccgttgccttcgtcgactaggtagtcgggactacgaaccgaaaaagtaaatagttcgtactttagttaccggtaaccaaacaaggaacgaccgacggacccgacggtcccctggttcgtttagtgtaattaataagttaaaacggactaacgtggaacggaccgggtacccctagaacggtaacgtacctccccgtaggaacggtcgtaactttccgttccgtcggtcctccgacgtccgtacggaacgggaccgacgcgtacggttccgtaacgttacgtaacttacgtacgtaacggtaggaaccgttaccgaacggtacgagggaccgggacggacggtacgtttacgaaccgtttaacgttaacgtcgtaaacctaaagtaacggtaaacggtacgaaaggttaaccggtaaggttaacctaggtttaagggttacggggttacggggttaccggggaccggggtaacgggtacccggtaaacggtcccggtaaccgggtaccccgtttaccggtaaccggttaccggtaaccgggtacccggaaaccgggttcccggttaccccggcccccggtttaacccggg

SEQ ID NO: 202402 - DNA, 756 bp, Homo sapiens
  misc_feature: GYAE6OF02GCVAY.21.46.E02.1.454.CMB.1.raw
  modified_base (503)..(503): a, c, t, g, unknown or other
  misc_feature (503)..(503): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatccacctgctctgcgagatggactgaccaaaagtaaatatcgtcttagttacggtaaccaaacagaacgccaggcccacggcccctgtgttagtgatatataaagacactgacgacggccctagagagtactcccgtagaggtaccgtacttccgtacgtcggtacctacccgacgtcctacgaacgggggaaccacggtactacggttaccgtaacggtttacgaacttaacttaccggaaggttaacggtaaacggttaccccgagggtaccgaaaggggaccgggtaaacggnggttaccgtacggtaacttaacgttaaccgtcgtaaaccgtaaacgtacggtaaacggtaccgtaaacgggttaaggtaacggttaaaccgttcgtaaagggttttcggggttacggttccgggggacggggtaaccggggtaacccgtaaacgggtacccttccgggtaaaccccgtttcccggtaaacgggttcccgaaccggtaaccccggtaaggtcccggtttacccccggccccccggttacccggg

SEQ ID NO: 202403 - DNA, 563 bp, Homo sapiens
  misc_feature: GYAE6OF02IZH9M.21.46.E02.1.454.CMB.1.raw
  modified_base (263)..(263): a, c, t, g, unknown or other
  misc_feature (263)..(263): n is a, c, g, or t
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctggtgtcagtcgtccccaggacagacggccaggatcacctgctctgcagatcggactgaccaaaagaaatatgacttattggtaaccaanagaagccagccaggcccctgtgttagtgaatatataaagacacgtgagacgccctnagagactcccngagcgtattcncgtggcctccagcgtacgaggcagcagtctacgtgactatcagtgacgtcagcagacggacgagcgtgaacttattacgtactacaaacgtagtacgaacgaggtaggaacgtacttacgtagtttcgggtgttcgggcggtaagggaacctaaggtctacgggtaacccgttccgtagggtaccaccggtacccgaagggcccgtccgtacccccgtacgg

SEQ ID NO: 202404 - DNA, 539 bp, Homo sapiens
  misc_feature: GYAE6OF02H0JGM.21.46.E02.1.454.CMB.1.raw
  modified_base (319)..(319): a, c, t, g, unknown or other
  misc_feature (319)..(319): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgacttattggtaccaaacagaagccaggccaggcccctgtgttagtgatataataaagacactgagacggccctnagagatccctagagcgattctactggctccagctacgagggacagacagtcacgtttgacttatcgtagtacgaacgtcgaaggacgaggacggacgaggctagactaattacngtaaccaaanagtagacagtaggaagtctgtagttgggtagttcggaggacggacgaagctacggaccgtcgtaggtcacgacccgaacggctccgccccgtacgg

SEQ ID NO: 202405 - DNA, 810 bp, Homo sapiens
  misc_feature: GYAE6OF02I1YB4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtcccaggacagacggccaggactcacctgctctgcagatggactgaccaaaagaaatatgacttagttgtaaccaacagaacgccaggccacggtcccctgtcgttagtgatataagtaaacgacacgtagacgacggccctacgagacgtactcccgtagacggtacggtactttccgtcgttcggcccttaccgaccgtcctaacggaacggggtaccacggacgtacggttaccgtaacggtttacggaaccttaacgttacgtaaacgggtacggttaaacggttacccggaaggggaccgtaaacggggtaaaccgggaacccgggtaagggtacccgttaaggtaaccgtttttaaaactttaacccgggtttacggtaaaacccgaaaacggttaaacgggttaacggaaaccgttaaacggggttaaacgtaacgggtttaaacctttacggtaagggtttttcgggggttagggttacccggggtacgggggtaaccggggtaaccggtaaacgggtcccggttaacgggtaaccccggtttccggtaagggttacccgtaccggggaaccccgtaacggggtcccgttcccgggtacccccccggtttaaccggg

SEQ ID NO: 202406 - DNA, 624 bp, Homo sapiens
  misc_feature: GYAE6OF02JEG3L.21.46.E02.1.454.CMB.1.raw
  modified_base (243)..(243): a, c, t, g, unknown or other
  misc_feature (243)..(243): n is a, c, g, or t
  modified_base (319)..(319): a, c, t, g, unknown or other
  misc_feature (319)..(319): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagaccggccaggatcacctgctctgcagatggactgaccaaagaatangtcttattggtaaccaacagaagccaggccacggcccctgtgttagtgatatataaagacactagagaggccctanagagactcccgtagacgcgtacttcgtcgtggcctcgacgtctcgaggactagctacgtcgtcgtgactatcgagtacgaagtccgaggtcgaaggacggacggaggcctaggaacttacgttacgtacgtaaccaaacgtaaggtaacgacgtaaaggtacggaacggttactaacgttaggtttggggttacgttacggggacgggtacggtaaccgaacggtccggtaccggtacccggtacccgttaaggttcccgaaccggacccgtaacggtcccgttcccggtacccccgttacccgg

SEQ ID NO: 202407 - DNA, 803 bp, Homo sapiens
  misc_feature: GYAE6OF02HZNHE.21.46.E02.1.454.CMB.1.raw
  modified_base (512)..(512): a, c, t, g, unknown or other
  misc_feature (512)..(512): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagccgtgacacacgccctaccgtcggtgtcgtaggttccgacccgaggacgacggaccggaccgaggtactcctaccgtcgccttcgtcgacgtaagtacggtacgggtaccacggaaaaccgaaaaagtaattacgttacggttaacttttacggttaaccggtaaccaaacgtaaggaccgaccgaccggaccgacccggtaccccgttggttacggttaggtactaacgtttaattaaaacggttaaacgaccgtaacgtaggtaacggacccggtcccttaacggaacggtaacgttacccgtaccccgttaagggaccgtaacggttaacctttccgttacggtccggttacncccgtacgttccgtaacgggaacggaccacgacgttacgtaccgttacggttaacgtacttacgacgttaacgggtagaaccggtacgaaggacgaaggacgggagacgttcgtaacgtacttacgttacgtacgtaaacaacgtagtaacgtacgtaagggtaacgttacggtacttacggttagggttcgggttcgggtacggacggggtacggaacgtaggtccgttacggtaccgttacggaccggttacgaccggtaccgaacggtctcccccggtacggtacccg

SEQ ID NO: 202408 - DNA, 689 bp, Homo sapiens
  misc_feature: GYAE6OF02FNNU7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggactcacctgctctgcagatggactgaccaaaagaaatagtgtcttattacgggtaaccaacaaggaacgacccgacgggacccgaacggtccccccgttggttcggttaagttcggtaattaagttaaagtaaaacggaacaacgttggaacggaacggtccctacgaaggacgtacttccccgtagacgcgtactttccttcgtcggtcctccgacgctcgagggtacacgcacgtcgtacgttcgactactcgtagtagtaacggtcgacgggacaagggaacggacggagtacgtagtacctaagtttaccgtagtaacaaacgtaggtaacgaacgtagtaaggtacggttactacgttaggtttcgggttacgtcggggacggtacgggaccgtaacgggtacttaccgggtaccggtaccgtttaacgggcacccgggtaacccgacggttcccgtacccggccccgttacccgg

SEQ ID NO: 202409 - DNA, 571 bp, Homo sapiens
  misc_feature: GYAE6OF02IGRJY.21.46.E02.1.454.CMB.1.raw
  modified_base (243)..(243): a, c, t, g, unknown or other
  misc_feature (243)..(243): n is a, c, g, or t
  modified_base (557)..(557): a, c, t, g, unknown or other
  misc_feature (557)..(557): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgcagatggactgaccaaaagaatntgacttattaggtaccaacagaacgccaggccacggcccctgtgttagtagatataataaagacacgtgagacggccctcagagtactccctaggacgacgtacttctcgtacggtctccgagctacgacgggacacgacgtacgtacgtacgttacgactagtacgagtacggtaacgtccgaaggcgaaggaggacgacggtctagacttattactagtacaaagagtagaacgagtagagtactacgtagttgggtgtcggacgggacggaccaaggtcctaggaccgttcgagtcgacgacccgaggtcnccgtaccccgtcgg

SEQ ID NO: 202410 - DNA, 661 bp, Homo sapiens
  misc_feature: GYAE6OF02HWV9M.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagcttgacacacgccaccctcggtgtcagtgtcccaggacaggacggccaggatccaccgtcgctcgtcgccagatacggactacgaccaaaagtaaatactgtacttaagttacgtaacaaacagtaacgcacggcacggccctgttgttaagtgaatactaagaaagacacgtggaagacggtccctacgagtacgattccccgtagaacgctaacgtttcctcgttagggaccttccgagtaccgtacgaacggggactacggaccgtaacgtccgtaaacgtttacgaacgtaactacgacggttacgaacgttaccgaagtaccgtaaggacggtacgaggtctacgaactttagttaaccgtgtaaccaaacgtacgtaacgtacgtaacgtagtacggtacttacggtagttacgggttagtaccgggagggtacggacgtaacgcgttcggtaccgtaccgtagtacgacgcccgaaggtccacccgtcccgttacg

SEQ ID NO: 202411 - DNA, 721 bp, Homo sapiens
  misc_feature: GYAE6OF02GEA7Z.21.46.E02.1.454.CMB.1.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgcctctgcagatggactgaccaaaagaatntgtacttattggtaaccaanagaacgccaggccacggcccctgtagttagtcgatataataaagacactagagacgccctacgagagactcccgtagacgcgtattcctcgtcggccttaccgaggtcctacgaacggggtaaccacggaccgtacggttccgtaacggtttacgaacttaacgtacgaaggttacggtaacggtaccgaacgggacgaagggtaacgggacggtaacggtaccgtacgtaaccgtttaacgtttaccgttacgtaaaccgaaaacgttaaggtaacgtaacggtaaacggttaacggtaacggttaccgttacgttaggttttcggggttacgggttaccgggggtaccgggtaagggaacccgtaaagggtccgttaaccggtaacccggttaccggtacgggtacctaccgggtacccgtaacgggtcccgtaccccggtccccgttacccgg

SEQ ID NO: 202412 - DNA, 664 bp, Homo sapiens
  misc_feature: GYAE6OF02HZ2IE.21.46.E02.1.454.CMB.1.raw
  modified_base (275)..(275): a, c, t, g, unknown or other
  misc_feature (275)..(275): n is a, c, g, or t
  modified_base (356)..(356): a, c, t, g, unknown or other
  misc_feature (356)..(356): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggcaggactcacctgctctgacagtagtcggactacgaccaaaaagaatagtgtacttagttacggaaccaaanaggaacgccgaacggccgtacgcccctaggttgttaagtagtaataagttaataaaacgacacgtgaagcggtacccctanaagtacgtactaccgtgaacgtcgtaatttctcggtagacctccgtagaccgttacgaaggggacacgggactacggtaccgtagtttaccgaagttacttacgaacggttagtaaacgtaccgacgggagaacggagggacggaacggtctaacggaacttaagttacgtacgttaacaaacgtagtaacgaacgtagtaacgacggttacaacgttaggttggttacgtcgggtacggacgggtacgacggacgtcggtaccgtacgtaggtacgacggacccaaggtccgtccgtccccgtacgg

SEQ ID NO: 202413 - DNA, 679 bp, Homo sapiens
  misc_feature: GYAE6OF02IKPES.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggactccacctgctctgcagatggactgaccaaaagtaatatgtacttattacggtaaccaactagaacgccaggccgacggccccttgtgttagtcgataataataaagacactagagacgccctacagagtactcccgtagacgtcgtacttccgtactcggcctccgagtccgtacgacgggacacgcgtacgtaccgtacggtttagacttagtaccgtaaggtacgtaaaccgtcccgaacggtacgaacgggaacgggaccgacggtaccgttagtaaccttaacgtttacgtacgtaaccgaaacgtagtaaacgacgtaaggtaagtaacggttactacggtaggtttcggggtacggttacgggacgggtaacggaccgtaacggtccgttacggtaacccgttacgtaacgggtcctaaccgggacccgtaacgggtccctaccccggtaccccgttacccgg

SEQ ID NO: 202414 - DNA, 561 bp, Homo sapiens
  misc_feature: GYAE6OF02F8GRV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggccccctgtgttacgtgatatataaagacactgagaggccctcagagatccctgacgcgattctctggcctccagctcgagggacagcgagtcacgttgactatctagtgaagtccgaggcagaggacggaggctagacttattactgtacaaacgagtagacgagtagaagttactctagttgggtgttcgggacgggtacggggaaccaaggtaccgtacggtacccggttaccgtaacgggtccgacggaccccgtaacgggccttaccggccccccgttacccgg

SEQ ID NO: 202415 - DNA, 549 bp, Homo sapiens
  misc_feature: GYAE6OF02FMVJP.21.46.E02.1.454.CMB.1.raw
  modified_base (243)..(243): a, c, t, g, unknown or other
  misc_feature (243)..(243): n is a, c, g, or t
  modified_base (429)..(429): a, c, t, g, unknown or other
  misc_feature (429)..(429): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatntgcttattggtaccaacagaagccaggccaggcccctgtgttagtgatataataaagacactgagaggccctacagagatcccctgagcgattctctggccttccgagctcgagggaacagacagtctacgttgactatcgtagtgaagtccgaggcgagacgggacgaggctagactaattacgnttacaaacagtagacagtagaggtactcgtagttgggtgttcgggcggagggaccgaacgtcgtacggtaccgttaccgtacggtcacggacccgtagggccttccggcccccgttccgg

SEQ ID NO: 202416 - DNA, 747 bp, Homo sapiens
  misc_feature: GYAE6OF02H4Y07.21.46.E02.1.454.CMB.1.raw
  modified_base (219)..(219): a, c, t, g, unknown or other
  misc_feature (219)..(219): n is a, c, g, or t
tcagtcgtcgctcgcacgaccggtgctcgatttagactcatctacagggaaaggggtgggtccagggaggcagaactctgggtgtctcaccatggcctggatcctctacttctcccctcctcactctctgcacacggctctgaggcctcctatgagctagacacacgccacctcggtgtcagtcgtcccaggtcagcgccaggatcactgctcctgacngatcggactcgaccaaagaaactatgtacttaagttcggtaaacctaagaacgaacgccaacggtccaacggtccccctaggttagttacggtacgaataacgtaaactaaaaagacgtaaccgttaggaacggtaacgcccgtagaacggtaacgaccttaccccgtacggaacggtcgtaacgtttccgtacgttcggaccctttccgaacggtccttaacgacggggtacaggtaccgtaacgtccgtaacgttcgaaacgttctaacgacgtagtaaacgtcccgaagggtcaagggaacggacggaacggttcgtaacgtaacggtttacttaacgtacgtaactaaaacgacgttaacgaacgtaagttaaggtacgttaaccgttcgttaacgggtttcgggttacgggttaccggaggggtaaaccggacggtaacggttcccttaacggtaacccgggttactaacgggtccgttaaccggaccggaaaggtcccgttacccgggccccctttaccggg

SEQ ID NO: 202417 - DNA, 615 bp, Homo sapiens
  misc_feature: GYAE6OF02H5XVY.21.46.E02.1.454.CMB.1.raw
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (310)..(310): a, c, t, g, unknown or other
  misc_feature (310)..(310): n is a, c, g, or t
  modified_base (351)..(351): a, c, t, g, unknown or other
  misc_feature (351)..(351): n is a, c, g, or t
  modified_base (402)..(402): a, c, t, g, unknown or other
  misc_feature (402)..(402): n is a, c, g, or t
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccagtggcctggatccctctacttcctccccctctcactctctgcacaggctctgagccctctatgacgctgacacagccctacccgtggtgtcagtcgtccccaggacagacggccaggtactcacctgctctgcagatggacngaccaaaaagaaatgtgtacttattacggaaccaanagaagccaggacacggtccctagtgtaagtgaataataanaaaagacactggaagcgtcccagaagagtactcctaggaancgtaattcctgtacgctccagctacgaagggacagcgtagacctaacgttntactaatcgagtagaacgtccaggacgaaggacggacgaaggtcgtanaacttagttactgtaaccaaaagagtaacgacgtaagtacggaacgttacgtataggttagggttcggttaccgggaccggtaagggtaaccgaacgacgttacggacccgttaccgaaggttccgaacgacccggtaaggtcccgttaccgcccccggttacgg

SEQ ID NO: 202418 - DNA, 588 bp, Homo sapiens
  misc_feature: GYAE6OF02IKN9J.21.46.E02.1.454.CMB.1.raw
  modified_base (178)..(178): a, c, t, g, unknown or other
  misc_feature (178)..(178): n is a, c, g, or t
  modified_base (244)..(244): a, c, t, g, unknown or other
  misc_feature (244)..(244): n is a, c, g, or t
  modified_base (337)..(337): a, c, t, g, unknown or other
  misc_feature (337)..(337): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacctcggtntcagtcgtccccaggacagaccggccaggatccacctgctctgcagatggactgaccaaaagaatntgtactttattacggtaaccaacgagaacgccaggccacggcccctgtcgttagtagataataataaagaccactagagacggcctacaaganactcccgagagctattcctgtgcctaccagtcctacggacgggacacgcgtagtccgtacgttgactacgtacgaagtgaacgtccgaggtcaaggaggacgagtcgtagtaacttattacgtagtaaccaaagtagtaagacgtaagtaggtacgtactcgtaggttcgggtacgttcgggacggtaggaccgaggccgtacggaaccgttcggagtccgacggacccgtaggcctccggcccgtaccgg

SEQ ID NO: 202419 - DNA, 799 bp, Homo sapiens
  misc_feature: GYAE6OF02ISK2R.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacggccaggatcactgctctgcagatcggactgaccaaagaatntcgtacttagttaggtaaccaacaggaacgccgacggccacggtacccctgttgttagtcggattagtaacttaaagactacgtagacggacggtccctacgagacgtactcccgtaggacgacgtactttccgtcgtcgggcccttaccgacgtccgttacggaacggggaacctacggtaccgtacggttaccgtaacggtttacgtaaccgttacgtacgtaacgggttaacggtaaccggtttaccgaacgggtacgtaaacgggtaacgggaaccggtacgggtcctaagggttaacccgttaacggtttaccgttaacggttaaccgtaaaacggtaggttaaccgtaaccggtaaaggggttaacggtaacggtttaaccgtaccggtttaggtttaccggggggttacgtttaaccgggggacggtaaaccggggacccgttaagggtacccgttaacgggtaacccggtttacccggtaacgggttacccgaccgggtaaccccgttaacggggacccttaccccggttaccccccggtttaacccggg

SEQ ID NO: 202420 - DNA, 544 bp, Homo sapiens
  misc_feature: GYAE6OF02GENNA.21.46.E02.1.454.CMB.1.raw
  modified_base (260)..(260): a, c, t, g, unknown or other
  misc_feature (260)..(260): n is a, c, g, or t
  modified_base (454)..(454): a, c, t, g, unknown or other
  misc_feature (454)..(454): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctgcagatggactgaccaaagaaatatgcttattggtaaccaanagaagccaggccacggcccctgtcgttagtgatataataaagactactggaagacggccctacgagagactccccgtagagcgtattctcgtggcctccagcctcgagggacacgcagtctacgttgacttatcagtagaacgtccgaggcaggacggacgaggctagacttagttactgtaacaaacgagtanacgagtagagttactctagttgggtgtcggacgaggaccaaggctacggaccgtacgtagacacgaccgaggtcctccgccccgttacgg

SEQ ID NO: 202421 - DNA, 651 bp, Homo sapiens
  misc_feature: GYAE6OF02G8ITH.21.46.E02.1.454.CMB.1.raw
  modified_base (178)..(178): a, c, t, g, unknown or other
  misc_feature (178)..(178): n is a, c, g, or t
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtntcagtcgtcccaggacagacggccaggatccacctgctctgcantcggactgacaaagaaatntgtacttatcggtaacaacgagaacgccgaggccacggtcccctggtagttagtcgtaagtataacgtaaagaccaagtagaggacgtcccgtagacgagtactcccgtagacgacgtagttctacgtcggtcctaccgaacgtctacggaacggtacagtactacgttacgacgttacgtaactagtacgaacggtacggaacgtacgagaccggtaaggaacggacggtaagcgtaacgtacttagttacgtagtaacgtaaacgtaggtaacacgtaagtaacgtacggttaacttcgtaggttacgggtggttaccgggacgggtaaggtaaccgaggtaccggtacggtaacccgttacggtacgacgtaccggtaccgacggtcccgttccgtacccgtaccgg

SEQ ID NO: 202422 - DNA, 757 bp, Homo sapiens
  misc_feature: GYAE6OF02ITWUZ.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatccactgctcgtgcagatggactgaccaaaagaaatntcgtacttaacgttcggtaaccaaacgagaaacgccaacggccacggccccttggtggttaaggtagtaactaagtaactaaaagaccaagtaggaacgacggaccctacgaagacgacttacccgtagacgacgtaacttccttcgtacggtctacccgaggtcctacggtacgggaacgacgtacgacgttacgtaacgtttacgaacttaacgttacgtaacgttacggtaaacgttcccgaaacggacggtaacggaacgggacgggaaccggtcgttacgggtaaccttaacgttaaccgtaggtaaacccgtaaaacgtaacggtaacgtaaccgtaaagtaaaccggttaacggttaaaccgttacggtaacggtttacggggttagggtttaccgggtacgggaacggggtaaccgaacgggttaccgtaccggtaacccggtacgttaaccggtaccgtacggaacccggtaaccggtaccgttaccggtaccccccgttacggg

SEQ ID NO: 202423 - DNA, 360 bp, Homo sapiens
  misc_feature: GYAE6OF02H4KPK.21.46.E02.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (335)..(360): a, c, t, g, unknown or other
  misc_feature (335)..(360): n is a, c, g, or t
tcagtcgtcgctcgcacgaccggtgctcgatttagactcatctacaggaaagggggtgggtccaggaggcagaactctgggtgtctcaccatggcctggatccctctacttcctccctcctcactctctgcacaggctctgacggcctcctatgagctgacacacgccctacccgtcggtgtcagttcgccccaagganacggccggcaaggctaccaccgtgcctctcgcaagngtagggaactggaaaccaaaagtaaatactggttattaacgttacgtaacaaacgaagacgacgaccggaccgaccggtccgtggttagttagtagaatnnnnnnnnnnnnnnnnnnnnnnnnnn

SEQ ID NO: 202424 - DNA, 681 bp, Homo sapiens
  misc_feature: GYAE6OF02F0DJE.21.46.E02.1.454.CMB.1.raw
  modified_base (303)..(303): a, c, t, g, unknown or other
  misc_feature (303)..(303): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtccagtcgtccccaggacagacggccaggatcacctgctctgcagatggactgaccaaaagaaatatgtactttattggtaaccaacagaacgccaggccacggcccctgtgttagtgatatanaagacatgagacggcctgagagactcctagagcgtattctcgtggtcctaccacgtcgtacgaacgggactacggacacggtacgtacgttacgtaccttagtacctaggtagtaaccggtccgaggacgtaggaacgggacgtaggtacgtagtaacgttaacgttacgtagtaacccgaaacgttaacggtaacgtaacgtaacggttaacggttaacggttacgttacgttaaggtttcggggttaccggtttaccggggtacgggtaaccgggtaaccgaacgggtacgttaccgggtacccggttaccggttaacgggttaccgtaaccggtacccgtaacgggtcccgttaccccggcccccgtttacccgg

SEQ ID NO: 202425 - DNA, 533 bp, Homo sapiens
  misc_feature: GYAE6OF02H8AA9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtcgtccccaggacagacggccaggatcacctgctctgcagatggactgaccaaaagaaatatgtcttattggtaaccaacagaagccaggccaggcccctgtgttagtgatataataaagacactgagacggccctacagagactccctgagcgtattcctctggctccagctacgagggacagcagtcacgttgactatcagtagacgtccgaggacaggacggacgaggcgtagacttattactagtacaaagtagtaagacgagtagagtactgagttgggtgtcggacggacggacgagctcggaccgtcgtaggtacgacgacccgaggtcctccgccccgtcgg

SEQ ID NO: 202426 - DNA, 897 bp, Homo sapiens
  misc_feature: GYAE6OF02HU0X5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgacggcctctatgagctgacacacgcctaccctggtgtcagtcgtcccgaggaccagacggcaggatccaccgtgtctcgtgacagtacgtacgggactcggaaaccaaaaggtaatacgtcgtactttaagtttacggtaacccaaacaacggtaacgacccgtacggaccgaccgggtacccccttggttacggtttagtcgtaagtaactaagtaaaacgactaacgtacggaacggtacggaccccgttgaagaacggtaccgttcccgttaaaggacggtaccgtaaacgtttcctacgttacgggcctttaccggaacggtaccgttacggaacggggtacaacgtacgtaaccggttccgaacggtttacgaaaccgttagttaccgtaaggttaacggtaaccgttaccggtaaacgggacgaacgggtaccggggtaaaccgtcgggtaacgttacccgaacgtttaaacgttacccggtttaagttaacccgaaaacgtttaacgggttaaaccggaaccgttaaaacgggtaagggttaacccggttaaacgtttaacccggttaagggtttacgggggttttacgggtaccggggttaaccggggtacgggtaaaccccggaaggttaccccgggttaacggttaaccccgggtttacccggtaacggttacccggtaaacccggtacccccggtaaaaccgggtttcccccggtacccggttacccccccggtttaaaccggg

SEQ ID NO: 202427 - DNA, 715 bp, Homo sapiens
  misc_feature: GYAE6OF02ISIFI.21.46.E02.1.454.CMB.1.raw
  modified_base (413)..(413): a, c, t, g, unknown or other
  misc_feature (413)..(413): n is a, c, g, or t
  modified_base (529)..(529): a, c, t, g, unknown or other
  misc_feature (529)..(529): n is a, c, g, or t
tcagtcgtcgctcgcacgaccggtgctcgatttagactcatctacagggaaaggggtggtccaggaggcagaactctgggtgtctcaccatggcctggatccctctacttcctccccctcctcactctctgcacaggctctgacggcctcctatcgagctagacacacgcccacccgtcggttgtcaggtccgtaccccgaggaccaggaccggccaaggactccaccgtgcctctcgacagagtacggactcgaaccaaaagtaatgtcgtactttacgttaacggaaccaagacgaaaccgccgaacggccctaccggtccctaggttacgttaggtacagtaaacgtaagtaaaggcctacgtaggacgaccgcccttagagtactacctccgaggaactgtaccttccncggtacgcctaccgtacgtcgtaacgacggggactcggtatacgggtacctaggttacactagtacgtacgtacgacccgtcgaggacggtacgaaccggaggtacgtacggttanaacgttaccgtttacgacgtaacgaacggttagtacgtaacgtggtaaccgtacggttaccgtgggttacgggtagtaccgggtacggaaccggttccgaacggttccgggtaaccgtacccgttgggtaaccgtcggacccggtaacccgtcgggtacccgttacccgtcccgggtaacctccgg

SEQ ID NO: 202428 - DNA, 740 bp, Homo sapiens
  misc_feature: GYAE6OF02H0CW1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtaccccgaggacagacggccaggactcaccgtgctctgacagatggactagacaaaagaatatgtacttagtacggtaaccaacaagacgccgaggaccacggccccttgttacgttagtagtaacttaataacgttaaacgactacgtagtaacggacggaccctacgaaggacgtaccgtcccgtaggacgtcgtacttcctcgtcggactccgtagtacctacggaacggacctacgacgtacggtcgtaaccggtttacgaactacgtacgtacgggttaagaaccggttaccgaacggacggaacggacgggtaacgacggtacgtacgtaacgtttaacgttacgtacgtaaaccgaaacgttaaggaacgtaacgtaagggtagtaacggtacttacggttaaggttggggtacgggtttccggggacggtaccggaacgggtaacggtacccggttacggtaaccccggttaggttaacccgggtacgtaacccgggtaacccggaaccggtttacccgtaccccgggtacccccgtttaaccggg

SEQ ID NO: 202429 - DNA, 863 bp, Homo sapiens
  misc_feature: GYAE6OF02FSBMO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggaccagacggccaggatcacctgcctctgcagatggactgaccaaaagaattatgactttattacggtaacccaagagaagccaggacccacggcccctgtgttacgtgattaataataaaacgacacgtggaacgacgggtcccctagagtaacgtacctccccgtaggtacgacgtaactttccgtacgtcggtaccctcccgtaacgtcttaccggaacggggtacctacggtaccggtaacggtttaacccgtaaccgggtttagtaaccccgtttaagtacccggtaaagggttaacgtaaaacccgggtttcccggaaacgggtacgtaacggggtaaacggggtacccggaaggggttaccctaacggtaaaccgttttaacggtttaaccgtaacggtttaaaccccgaaaaacggttacggtaaaccggtaacggttaacgggttaaacgggtaaccggggtttaaacccttggtaaaccggggtttttaggggggttaccggtttacccgggggacggggggtaaacgtaaacccgggtaaggtacccggtttaaccggggtaaccccgtttaacccggttacggggttaacccgacccggggtaacccccgtaaacggggtccccgtttacccggggtacccccccgtttaacccgggg

SEQ ID NO: 202430 - DNA, 743 bp, Homo sapiens
  misc_feature: GYAE6OF02JDH2Q.21.46.E02.1.454.CMB.1.raw
  modified_base (247)..(247): a, c, t, g, unknown or other
  misc_feature (247)..(247): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggtactcacctgctctgcagagtggactgaccaaagaaatntgcttattggtaccaacagaagccaggcaggcccctgtcgtagtnatactataaagacactgagacggccctanagacgtactccccgtaggacgacgtaatttcctaccgttgggtacccttaccacggtacccttcggaaacggggaccctaacggtaccgaacggtttcccgtaacggttttacgggaaccctttaacgttaccgtaacgggtttaaccggtaaaccgggtttacccgaacgggttaccggaaacgggaaaccggggaaccggtaaccggggttaccggttacgtaaacccggtttaacttttaaacccgttcggtttaaacccgaaaaccgttaaggttaacgaaaccgttaaggttaacggtaacgtttacgacgttaaagttcggggttacgtttaccgggacgggtacggaacgaacggtcggtcgtaaccgtcgttaggtaccgacgtacccgtaggtccgtaccgcccccgttacgg

SEQ ID NO: 202431 - DNA, 792 bp, Homo sapiens
  misc_feature: GYAE6OF02JWE7M.21.46.E02.1.454.CMB.1.raw
tcagtcgtcgctcgcacgaccggtgctcgatttagactcatctacagggaaagggggtgggtccgaggaggcagaactctgggtgtctcaccatggcctggatcctctacttctcccctcctcactctctgcacagctctgaggcctcctatgagctgacacagccaccctcggtcgtcagtcgtaccccaggacagacggaccaggaactccacctgcctactgaccagatggactcggaaccaaaagtaatagtcgtacttacgttaggtaaccctaacgaacgaacgaccgacggacccgaacggcccccttaggtcggttacgtagtaacttaagtaacgtaaaaacgactaacgtagaacggacggacccgttacgaaggtacgtaacttacccgagtaacgacggtaaccttcgttccgtacggtaccgtccgaggtcctaccggaacggggtacaacggtaccgtaacggttacctaccgtttaacgggaccctttaaacgtaccgttaacgggttaacgaaaccgggttacccgaaacgggtacccggaaagggtaccgggaacggtaagggtccgttaacgtaacgttacttaaccgtattaaacccgaaagtaacgttaacgaaggtaaaccgtaagggaaccggttttaacgacggttaaggtttacgggtacggttccggtacggggacggtaacccggaaggttccggtacggtacccgttacgttaccggttaaccgcgggtaaccccacgggttcctacccggacccccgtttccgg

SEQ ID NO: 202432 - DNA, 687 bp, Homo sapiens
  misc_feature: GYAE6OF02G7EEA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacacgcccacccgtcggtgtcagtcgtcccgaggacgacggaccggaccaggactcacctgctctgcagagtggactcgaaccaaaagtaatgtacgtactttagttacggtaaccaacgaaggaacgccgacggacccgaccggtccccgttggttacgttaggtagtaattaagttaacgtaaaacgtaccaacgtaggaacggtaccggtccctacgaacggtacgtacctaccccgtaggacgtacgtactttccgttcgtacggtccgtaccgagtccgtacgggaacgggtaccacggtaccgtacggtaccgtacggttacgtaacctagtacgtagtacggtaaccggtaccgaggacgaagggacggacggaggtactagtacttacttactacgtaacaagtagtagacgtagagtagtacgtgtaggttagggtgttcgggaggtacggtacgacgtcgtaccgtaccgttacgacgtacgaccgaccgaacggtccctaccggtcccgtacg

SEQ ID NO: 202433 - DNA, 563 bp, Homo sapiens
  misc_feature: GYAE6OF02HN8HZ.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatntgacttattcggtaccaaacagaagccaggccaggcccctgtcgttagtgatatataaaagacactgagacggccctacagagactccctagagcgattctctggctccagctacgaggacagcagtcacgttgactatctagtgaagtcgaaggcgtaggaggacgaggcgtgacttagttactagtaccaaagagtaagacaagtaaggtagttaactcgtagttgggttagttcgggacgggacggaaccgaaggccgtacggtaacccgtcgttaacggtcgacgacccgaacggtccgtacgccccccgttaccgg

SEQ ID NO: 202434 - DNA, 649 bp, Homo sapiens
  misc_feature: GYAE6OF02JYT9X.21.46.E02.1.454.CMB.1.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (386)..(386): a, c, t, g, unknown or other
  misc_feature (386)..(386): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcgacctgctctgacagatcggactgaccaaagtaaatntcggacttatcggtaaccaacgagaacgcgaggaccacggcccctgtcgttagtnagtatataacgacactgacgacggccctgagagactcccgtagacgacgtacttctcgtgccttaccgacgctacgaggtacngacgagtccaacgttgaactagtcgtaacgtagtaacggaccctagggaccgtaaggacggacggaacgtcgttaacgacttaacgttactcggtaaaccgttaagaaccggttaagaaccgtaggttaaccggtacgtaacgttacgtaggttacgggtacggttaccggaccgggtaggtaaccgacggttacgcggttaacccgtaccgttaggacctaacgtccccggaagttacccgtcccgtaccccgttacccggg

SEQ ID NO: 202435 - DNA, 626 bp, Homo sapiens
  misc_feature: GYAE6OF02FTDD5.21.46.E02.1.454.CMB.1.raw
  modified_base (293)..(293): a, c, t, g, unknown or other
  misc_feature (293)..(293): n is a, c, g, or t
  modified_base (401)..(401): a, c, t, g, unknown or other
  misc_feature (401)..(401): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctggtgtcagtgtccccaggacagacggccaggatccacctgctctgcagatggactgaccaaaagaatatgtacttattcggtaccaacagaacgccacggccgacggcccctgtgttagngtatatataaagacactgagacgccctagagagactcccctaggacgcgtattcgtcgtggcctcgacgtctcgacgggacagcgtacgtccgtacgttgacgttacncgtaagtagtaacgtccgaaggtcaaggtacgggacgaggtacagtacttaacgttacgtacgtacaaacgagttaagaccgtaaggttaggaacggttaccgtagttaacgtttacggggtcggttacggggacgggaacgggtacgaacggtccggtacgtaacccggttaccgtacggtacgccggaacccgtacggccggtaccccgtcccccgtaccggg

SEQ ID NO: 202436 - DNA, 673 bp, Homo sapiens
  misc_feature: GYAE6OF02G3V46.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgtacttagttacggtaccaacagaacgccaggccacggcccctgtcgttagagtatatataaagacacgtagagacggccctagagacgtactacccgtagacgcgtacttctcgtcggtcctaccgacgcgtacgacgggacacggtacgacgttccgtaacggtttcgaacttacgtacgaaggttaacgaacggtacccgaagggacgaaggtaaacgggaccggacgggtacgtaggtacttaacgttacttaggtaaccaaacgtagtaacgaacgtaaggtaacgaacggttacgtacgttaggttcgggttacggtacggggtaccgggaagggaccgtaacggccgttacggaacccggttaccggtaacggttaccgaccggtacccgtaaccgggccggttacccgcccccggttacggg

SEQ ID NO: 202437 - DNA, 624 bp, Homo sapiens
  misc_feature: GYAE6OF02GU2E2.21.46.E02.1.454.CMB.1.raw
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatntgcttattggtaccaacagaagccaggccaggcccctgtcgttagtgatatataaagacactgagaggcctcagagatccctgagcgattctacgtggctccagctcgaggacagacagtcacgtttgactatcagtgaacgtcgaaggtcgaagacgggaacggaggtactgaacttacgttacgtacgtaccgaaaactaggtaacgaacgtaaggtaacggtaacggttactaccgtaagtttcggggtacgtttccggggaccgggttacggggaacccgtaacgggttacgttaccggaacccggtttaccgttaacgggtaccgtaacggtacccccggtaacgggtcccggttaccggccccccgttaacccgggg

SEQ ID NO: 202438 - DNA, 608 bp, Homo sapiens
  misc_feature: GYAE6OF02H5T6R.21.46.E02.1.454.CMB.1.raw
  modified_base (245)..(245): a, c, t, g, unknown or other
  misc_feature (245)..(245): n is a, c, g, or t
  modified_base (341)..(341): a, c, t, g, unknown or other
  misc_feature (341)..(341): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagaccggccaggatccacctgctctgcagatgactgaccaaaagaaatntgcttattcgtaccaacagaacgccaggaccgacggtcccctgtgttagtgatataataaagacactagagacgggccctagacgagactccgagngcgtattcgtcgtgcctcagctacgaggacaggctagtcctacgtttacgactatcgaagtacgaacgtcccgaggacgaggaacggacggagacgtagtaacgttattacgtagtaacgaaacgagtaacgacgaaggtaagtacgtacgtagtaggttgggtaggttcggacgggtaccggactaaggtccttacgggtaacccgttacgtacggtaccgacggtaaccccggtacgggaccttccccggtacccccgttaccgg

SEQ ID NO: 202439 - DNA, 725 bp, Homo sapiens
  misc_feature: GYAE6OF02I4QXT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagctgacacagcccaccctcggtgtcagtcgtccccgaggacagaccggccaggactcacctgctcctgacagatggactcgaccaaaagaaatatgtactttagttacggtaaccaacgaaggtaacgacccgacggaccccgaaccgggtcccccgttaggttcggtttaagtagtaagttaattaaagtaaaacggtaacctacgtaggaacggaccggtccctacgaaggacgtaccgttccccgtaggaacggtacgtacgtttccgtacgtcggtccctccgacgtccgtacgaacgggacgacggacctacggtaccgtacggttactaacttaagtacggtaagtaacggtaacgtccggaacggacgaagggacgggaggacggtctaggtaacttacgttactacgtaacaagtaacgtagacgtaggtaagtacggtactacgttaggttagggttacggttacgggacgggtacggtaaccgtaggtaccgtacggtaacccggttacgtaggttccgaccgtacccggaggtcccgtacccgtcccggtacccgg

SEQ ID NO: 202440 - DNA, 760 bp, Homo sapiens
  misc_feature: GYAE6OF02HB1FD.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctgcagatggactgaccaaaagtaaatatcgtactttaagtttacggtaaccaaacgaagaaacgaccgaagggacccgaacgggccccccttaggttacggtttaacggtacggtaattaacgtaaagttaaaaacgaacctaacgttacggaacggacgggccccttacgaacggaagtaaccttccccgtaggacggtaccgtacgtttacctcgttcgggtaccttcccgaagtccgttacgaacggggtaaccgacgacctagtaccgtaacggttcgtaacttacgtacgtaaggtagtaaacgtccgaaaggaccaagggaaggacgggagtacgttagaactttaactacgttacgtaacctaaacgtaaggtaagaacgtaagggtaacgtacgttacgttacgtaacggtttggggtacggtttacgggacggggaacgggtaacctaagggaccgttacggtaacccggttaccggtaaggttccggaacccggtcccgtaaacgggtcccgttaccccggccccggttacccgg

SEQ ID NO: 202441 - DNA, 719 bp, Homo sapiens
  misc_feature: GYAE6OF02HQIF4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctgcagatggactgaccaaaagaatatgtcttattacggtaccaacagaagccaggccagcccctgtgttagtgatataataaagacactgagacggccctacgagacgactcccgtaggacgacgtattcctcgtggctaccgacgctacgagggacacgaccgagtacgtacggtttagaaccttacgtacgtaagggtagtaaacggtcgaagggtacgaagggaacgggacggacgggtacgtacgtaacgtttaacgttaacgttacgtaaccgaaaacgttaggtaaacgtaacgtaagggttaaggtaaacgggtttaaccgttacgttaacgggtttaggggtttacgggttacggggtaccggggtaacggggtaaaccgtaacgggtaccggttaccgggtaccccggttaaccgggttaaccggtacccggtaacccggaccccgggtaaccgggtcccgttaccccgggtaccccccggtttacccggg

SEQ ID NO: 202442 - DNA, 624 bp, Homo sapiens
  misc_feature: GYAE6OF02INQY9.21.46.E02.1.454.CMB.1.raw
  modified_base (180)..(180): a, c, t, g, unknown or other
  misc_feature (180)..(180): n is a, c, g, or t
  modified_base (486)..(486): a, c, t, g, unknown or other
  misc_feature (486)..(486): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtntcagtcgtccccaggacagacggccaggatccacctgctctgcagatcggacctgaccaaaagaaatatgtacttattaggtaacccaactaagaagccaggacccacggccccctgtgtttagtgaatataataaagacatagaggacggccctacagagtactccctgagcgattctcgtcggtcctaccagtctacggaggacacgctacgtcgacgttacgacttacgtcaaggtagtaacgtcccgtaaggtacgaagggtacgggaccgtagggacttggaacttacttacgttacgtanaaacgtaagtaacggtacaaggtaggtaacgtacgttacgtagtttagggtgttaccgggcgggtaacgggaccgaaggtcgtacgtaccgttcgtacggtcgacggacccgtaacggccgttaccgaccccttccgg

SEQ ID NO: 202443 - DNA, 600 bp, Homo sapiens
  misc_feature: GYAE6OF02I6HR3.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgcctctgcagatcggactgaccaaagaatntgtcttattggtaccaacagacgaccaggccacggccctgtgttagtgatatataacgacacgtagagacggtcctacgagacgtactcccgtagacgcgtacttcgtcgtcgtctaccacgctcgacggacacgcagtcgtacgttcgactactcgtagtcgaacgtcgaggacgagaacggacgaggtctagtacttagttactacgtaactaagtagtacgaacgtagtacggtacgttactacgtagttgggtcgttacgggacggtacgggtaaccgtaacggtccgtacggtaccggttaccgacggtaccgacggtccgtaacggtccgtaccggtccccgttaccgg

SEQ ID NO: 202444 - DNA, 809 bp, Homo sapiens
  misc_feature: GYAE6OF02JWKPY.21.46.E02.1.454.CMB.1.raw
tcagtcgtcgctcgcacgaccggtgctcgatttagactcatctacagggaaagggggtgggtccaggaggcagaactctgggtgtctcgaccatggcctggatcctctacttctcccctcctcactctcgtgcacaggctctgaggcctcctatagagtctgacacagccaccctcggtgtcaggtcgtcccaggacacgacggccaggatcacctgctctcgcagactggactggaccaaaagaactgtcgtactttagttacggtaaccaagtaggaacgccgaacggccgacggccccttggttacgttaggtgtaattaagtacttaaaacggactacgttaggagtaacgggcccttagaaggacgtactccccttaggaacggtcctaatttccgtacgttcgggccttacccgaaggtcttacggacggggaccaacggtaccgtaggtccttaaccggtttagtaaccgttaagttacccggtaaaggttagggtaaacccggtaccgtaacggggttaaccgaacggggttaacggggaaacccggtacgggttccgttaacggtaaacttttaccgttaacgtaccggttaaccgtaaaccggtagtaaaccggtacgttaacgggtaaacgacggtttaaccttacgtaacgggtttcggggtaccgggtttacggggacggggtaaccgggtaacccggtaaacgggttaccgtccggggttaacccgttacgggtaccggttccgtaaccggtccccgggtaaggtcccccgttaacgggtccccccgttaacggg

SEQ ID NO: 202445 - DNA, 528 bp, Homo sapiens
  misc_feature: GYAE6OF02HLZ0W.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatccacctgctctgcagatggactgaccaaagaatatgcttattggtaccaacagaagccaggccaggcccctgtgtagtgatatataaagacactgagacggccctacgagagactcccgtgacgcgattctcgtggcctccgagctacgagggacagacagtctacgttgactagtcagtgaagtccgaaggcaggaggacgaggctagactacttatgtaacaagagtaagacagtagagtactgtagtggtcgtgggcggaggacgaaggctacgtaccgtccgtaggtcacgacccgaggtccgtcgtaccccgtcgg

SEQ ID NO: 202446 - DNA, 648 bp, Homo sapiens
  misc_feature: GYAE6OF02FVAWB.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgcctctgcagatggactgaccaaagaaatatgcttagttacggtaaccaacgagaacgccaggccacggccctgtgttagtgatataataaagacacgtgagacggccctacagagacttacccgtagacgcgtactttcgtcgtggcctccagcctcgaaggacagacagtctacgtgactatacagtagacgtcgaggtacaggaggacgaggtactagtacttattacgtacgtacaaacgtacgtagaacgtaagtaaggtacggttaacgtacgttaagggtttacggggttacggttaccggggacgggtaaccgggtaccgtaaacggtccgttaacggtaaccccggttacccggtaagggttacccgaacccgggtaaccccggtaaccgggtcccgttaccccgggtccccccggttaacccggg

SEQ ID NO: 202447 - DNA, 800 bp, Homo sapiens
  misc_feature: GYAE6OF02IZR93.21.46.E02.1.454.CMB.1.raw
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
tcagtcgtcgctcgcacgaccggtgctcgatttagactcatctacaggaaagggggtgggtccgaggaggcagagctctgggaagtctcaccatggcctggacccctctcctgctcccctcctcactttctgcactagtctctgacggctcctatgagctgacacagccaccctcggtctcagtgtcccgggacaaacggccaggatcacctgctctggngatgcatagacctaaaaattntacgttttggaccagcagtaagtcaggccaggtccctgtcgttgcatccgataggacgagacgaccgaccgtcccggtaagtccccgtagacgtagacgttccctacgtcggaccgtacccgtaaaccgttccgaacgggggaaccggggttaccgggtacccaacggttttcggggtaacgtttaccgttccgtaacgggttcggggggacccctaacgggtaagggtttaccgggaaacgttcggaacgggtaccttacgaacgttaaccgttaacctcggttaaccgtcctaaagggaccgtacggtaacctagggtaccggtacggtagggtttccgaagggttccgtaacgggggttaccggaagggtttacccggggtaccgggaaccggggtttaacccgaaccgggtttacgggtaacccgggttccgtaacgggtcccgtaacgggtccccgtaaacgggtaccccgttacgggtaccccccgtacggttccgaacccgtttccccgttaccggttcccctaaccccgttacccgttacccgttacccgg

SEQ ID NO: 202448 - DNA, 567 bp, Homo sapiens
  misc_feature: GYAE6OF02GQAIP.21.46.E02.1.454.CMB.1.raw
  modified_base (261)..(261): a, c, t, g, unknown or other
  misc_feature (261)..(261): n is a, c, g, or t
  modified_base (319)..(319): a, c, t, g, unknown or other
  misc_feature (319)..(319): n is a, c, g, or t
  modified_base (374)..(374): a, c, t, g, unknown or other
  misc_feature (374)..(374): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatatgtcttattggtaccaanagaagccaggccacggcccctgtgttagtgatatataaagacactgagacggccctanagagactcccgtgagcgtattctcgtggcctcagctcgaggacagcagtcacgtnactatcagtgaacgtcgaggacgtaggaggacggaggctagtacttattacgtgtacaaacgagtacgacgaagtagtaacggttactagtaggttaggggttcgttacgggacgggacgggaccgtaagtccggtacgacccggttaccgtaggtcgacggacccgaacggtcctcccggccccttaccggg

SEQ ID NO: 202449 - DNA, 752 bp, Homo sapiens
  misc_feature: GYAE6OF02JYZB3.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctaatgagctgacacagccaccctcggtgtcagtcgtccccaggacagaccggccaggatcacctgctctgcagtatgggactcgaccaaaanaaagttatgtacttagttaggtaacccaacaagaacggcctaacgggcgttaacgggcccccttggtaggtttagtaggtaattataaattaaaggacaacttggaacgaccggccttcgaagacgactcccctagaggaccgtattctaccgtgtcctccgtagctccgacgggacaagtccgagtaccgtacgttacgaaccttagtccgtaagttacggaacgtacccgaggtacccgaaggaacgggacgacggttctaccgggtaccttaacggttacgtgtaaccgtaaaacggtaccgttaaacggacccggtaaagttaacgggtaccgttaaccgttacgtttaacgggttgggtttacccgggttacggggtacggacgggggtaaccgaaacccggtttgaaccccggtttaaaccgggtcccgttaacgggttaaccgaacccggtaaacccgttaacgggtaaccccgttacccgggtacccccccttaaccgggg

SEQ ID NO: 202450 - DNA, 603 bp, Homo sapiens
  misc_feature: GYAE6OF02F7EXY.21.46.E02.1.454.CMB.1.raw
  modified_base (243)..(243): a, c, t, g, unknown or other
  misc_feature (243)..(243): n is a, c, g, or t
  modified_base (263)..(263): a, c, t, g, unknown or other
  misc_feature (263)..(263): n is a, c, g, or t
  modified_base (347)..(347): a, c, t, g, unknown or other
  misc_feature (347)..(347): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaatntgctttattcggtaaccaanagaacgccgaggccgacggccctgtcgttagtgatataataaagacacgtgagacggcctagacgagactccagagctattcgngtggcctcgagtctacgacgggacaggctagtcgtacgttanactacgtctagngaacgtcaaggcgaaggacggacgaggtctacgtacttacttacgtgtaacaaagtgtaagactaaggtacgtaggttactagtaggtttagggtgttaccggggacggtaacgggtaacgtacggtacttaccgggacccgtttaccggtaaggtccgaccggtacccgtaacgggtcccttacccggccccgttacccgg

SEQ ID NO: 202451 - DNA, 543 bp, Homo sapiens
  misc_feature: GYAE6OF02JEB5R.21.46.E02.1.454.CMB.1.raw
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgccaaagaaatatgcttattggtaccaacagaagccaggccacggcccctgtcgttagtgatatataaagacactgagacggccctcagagatccctgagcgattctctgctccagctcaggacagcagtcacgttgactatcagtgaagtccaggcaggaggacgagctgacttatactgtacaaacagtacganagtagaggtactcgagtttcgggtgttacggcgggtaagggacccgtaaggtacgtacggacccggtaccgttaaggtccgacggtacccgaaggtccctaccggccccccgttaccgg

SEQ ID NO: 202452 - DNA, 806 bp, Homo sapiens
  misc_feature: GYAE6OF02HYUPW.21.46.E02.1.454.CMB.1.raw
tcagtcgtcgctcgcacgaccggtgctcgatttagactcatctacagggaaagggggtggtccaggaggcagaactctgggtgtctcaccatggcctgggatccctctacttcctcccctcctcactctctgcacaggctctgaggcctcctatgagctagacacacgcctacccgtcggtgtcaggtcgtccccagggacaggacggccaaggatcacctgctctgcgagagtggactgaccaaaaagaattatcggactttaagttacggtaaaccaaaacgaagaacgaccgaacggcccgtaacgggcccccgttaggttacggttaacgtagaagttaaattaaagttaaaaacggactaaacgttacggaacggaacgggtaccccgttagaaacgggacgtaaccgttaccccgtaggaacgtaccggtaacgttcccgttcgttacgggaccttacccgtaagtaccgttacggacggggaaacctagaccgtacgtacgtaaccggtttacgaaacttacgtacgtaacggttaaggaaacgttaccgaagggtaaccgaagggtaacgggaacggaagggtacgttaacgtaacgtttaaacgttacgttaagtaaacccgtaaaagtacggtaaacgtaaacggttaagaaccggttaaggttaaccttacgttaggtttacgggtagggtttacccgggaacgggtaacgggtaaccaaaggttccgacggtaaccgttacccgtaggtaccgaccggaacccgtaacggtcccgtaccggaccccgttaccgg

SEQ ID NO: 202453 - DNA, 716 bp, Homo sapiens
  misc_feature: GYAE6OF02HHHU2.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctgcagatggactgaccaaagaaatntgtcttattacggtaaccaacgagaacgaccgaggacccacggtcccccgtggttgttaacgtgaatagtaataaacgacacgtagacgacggccctcaagagactcccgtagacgcgtattccgtcgtcggctccgtagtctacggaggacgacgctacggtacctacggttcgtaaccttacgtaccgtaaggttaccgaaacgggttcccgaagggtacgaaggggaaccgggacgtaagggtccgttacggtaactttagttacgttagtaaccgttaaaacgaggtaagtaaccgaaggttaaggtaacgggtaacttacggttacggtttcggggttacgggtttaccgggaccggggaacgggtaaccgtaacggttaccggtaccggtaaaccggttccccggttaggtaccgaaccgggtccccgaagggtttaccccgtccccggtaccccggtttacccgg

SEQ ID NO: 202454 - DNA, 544 bp, Homo sapiens
  misc_feature: GYAE6OF02HUKBJ.21.46.E02.1.454.CMB.1.raw
  modified_base (180)..(180): a, c, t, g, unknown or other
  misc_feature (180)..(180): n is a, c, g, or t
  modified_base (323)..(323): a, c, t, g, unknown or other
  misc_feature (323)..(323): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtntcagtcgtccccaggaccagacggccaggatcacctgctctgcagatggactgaccaaaagaatatgtacttagttcggtaaccaacagaacgccaggccaggcccctgtgtagtgatatataaagacactgagacggccctnagagactcctgagcattctctgctccagctcgaggacagcagtctacgtgtatatactagtgtaacgtcgaggacaggaggacgagcgtgtactatactatacgaanagtanacgagtagtacgtacttcgagttggtgtacggacgggacggaccgaagtccgtacgtacccggtacgtacggtcgaccggccgtaacggccgtaccgtccccgttacgg

SEQ ID NO: 202455 - DNA, 780 bp, Homo sapiens
  misc_feature: GYAE6OF02G34M9.21.46.E02.1.454.CMB.1.raw
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacacgcccacccgtcggtgtcagtcgtccccgaggacagacggccaggactccacctgcctntgcaagngcggactcgaaccaaaagtaaatatgtacttagttacggtaaccaaacaagaacgaccgaacggccgacggtccccgttaggttacgttagtagtaattaagtaaacgtaaaaggacctacgtaggaacggtaccggtacccgtacgaacggtacgtaccgttcccgtaaggtaccggaccgtttaacgtttccgtaccgttcgggtaccccttaaccggaacggtccgtacgggaaacgggaacctaacggtaccgtacggttaacccgtaacggtttacgtaaccttaacgttacgtaagggtaaccgaacgtaccggaacggacgaacgggaaacgggacggacggtacgttagtaactaactttacgtacgttaacaaacgtaggtacgtaacgtagtaacggtagttaactaggttacggttcggggttacggtaccggggtacgggaacggtaccggaacggtacgttaccgggtaccgttacccgggttaagacgtaaccggtaccgtaaccgggtcccgtaccccggttaccccgtacgg

SEQ ID NO: 202456 - DNA, 661 bp, Homo sapiens
  misc_feature: GYAE6OF02I7JZT.21.46.E02.1.454.CMB.1.raw
  modified_base (156)..(156): a, c, t, g, unknown or other
  misc_feature (156)..(156): n is a, c, g, or t
  modified_base (174)..(174): a, c, t, g, unknown or other
  misc_feature (174)..(174): n is a, c, g, or t
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctctatgagcngacacgagccaccctggntcagtgtcccaggacagcggccaggatacacctgctntgacagtagtcggactcgaacaaaagaattntacgctttagttcggaaccaacaagaacgaccgaaggacccaggccccttggtagttagtgtaataatataaaagacacgtagaagacggcctcgaagaggactccgtagacggtacgtattactcgtggccttccgaaggccttacggaacgggacacgtacgaacgttactaacggtttacggaacttacgtacgaaggttaggaaccgtaccgtaaagggacgtagggaacggacggacgttacctaaggtaaccttaagtttaaccctaggaaaccctaaagtaagttaacggaataaacgggttacgaacgttacgttacggtaggtttacggggttttaccggggaggaaggtccgaagtccgtgaaccgtacgttaagtacgaccgtaccggagacccgttcgaccctccgg

SEQ ID NO: 202457 - DNA, 809 bp, Homo sapiens
  misc_feature: GYAE6OF02IR5TX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgaccacacgcccaccctcggtgtcagtcgtccccaggacacgaccgcaggactccaccgtgctctcgacagtagtcggacctcgaaccaaaaagtaaatgtacgtactttaacgttacggtaaaccaaacgacggtaacgaccgacggaccgtaaccggtccccgttaggttacggttagtaacgtaacttaaagttaaacgaaaacgtaccgtacgtaacggtaacggaccggtaccctacggtaaagaccgttacgtacccgttaggaccggttacgttaacgtttccgtacgtaccggtacctaccggtacggtaccgtacgggaacgggtaacctacggtaccgtacggttaaccgtacggtacgtaactacgtacgtacgtacgtaaccgtacggacgacggtacggacggtacggtcgtacgaacgttacgttaacgtccgtaaacgtaacgtaacgtaacgtacgtaacgtaaacggttacggttaacggtaccgttaacgggttagggttaccgggttaacgggtaccgggtaacgggtaccggtaaaccgacggttccggtacccggttaacgttacccggtaggtaacccgaccgggtaacccgttaccggtcccccggttaccgtcccggttaacccgg

SEQ ID NO: 202458 - DNA, 754 bp, Homo sapiens
  misc_feature: GYAE6OF02H2FIJ.21.46.E02.1.454.CMB.1.raw
tcagtcgtcgctcgcacgaccggtgctcgatttagactcatctacagggaaagggggtgggtccgaggaggcagaactctgggtgtctcaccatggcctggatcctctacttctcccctcctcactctctgcacaggctctgagcctcctatgagctgacacagcccaccctcggtgtcagtcgtccccaggacagacggccaggatcacctgctctgcagatggaactggaccaaaaagaaatagtgtacgtttaattacgggtaaccaaacgaaggaaagaccgacggaccgaacgggtccccccttggttggttaacggtgtaagttaagttaaattaaaaacggacaaccgttaggaaggaaccggtcccctagaagacggacttcccgtaggacgcgtaatttccgtctacgggtctaccgtaggctaccgaggggacaagggcaacggttactaaccggttagacttagtccgtaaggtacgaaacgtcgaacggacgaagggtaacgggacgaagggtactaggtaaccttaacggtttaaacctgggtttaaaacccaaaacggttaaacggtaaacgtaacgtaaacgggttaaaggtacggttaaaccttaccggtaaggtttagggttacgggtttacgggaccggggtaaagggtaccgaaacggtcgttaccggaacggttacccgtagggttacccgacggtaaccccgtaacgggtctaccccggtaccccgttcccgg

SEQ ID NO: 202459 - DNA, 654 bp, Homo sapiens
  misc_feature: GYAE6OF02F5FKO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagctgacacagccaccctcggtgtcagtcgtccccaggacagacggccaggtactcacctgctctgcagatggactgaccaaaagaaattatcgtctttatggtaaccaacgagaagaccaggccgacgccccttgtagttagtgtataataagtaaacgacacgtaggaagacggccctagagacgtacgtccgtagacgacgtactttcgtcgtcggtacctaccgacggtcctacggaacgggaccaacgtccaggttacctaacggtttacgaacttacggtacctaggtaggaacgttacccggaaggaccgaagggacggacggacggtacgtacggtaacgttaagttaccgtacgtaacgtaaacgtagtaacgacgtaagtaggtacgttactagtaggttgggttagtcgggacggaacggtacgacggtcgtaggtacccgtagtacggtaccgtcggaccgtacgccgtaccgtcccccgtacgg

SEQ ID NO: 202460 - DNA, 782 bp, Homo sapiens
  misc_feature: GYAE6OF02IEZTO.21.46.E02.1.454.CMB.1.raw
  modified_base (218)..(218): a, c, t, g, unknown or other
  misc_feature (218)..(218): n is a, c, g, or t
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctcngcagagtgactgaaccaaagaatntgtactttagttacggtaaccaacgaagaacgaccgacggaccgacggtcccccttaggttacggttaagtacggaattaattaaagttaaaacgaactaacgtaggaacgaccggtcccctacgaaggtaacgtacgtaccccgtaggtacgacgttacttccgttcggtccggtcctacccgtaacgtcgttaacggaacggggtaaccgaacggccgtaacggttaccgtaaccgttttacgaaaccgttcgtaacgtacgggttaacgtaaaccggttccgaaacgggtacgaaacggggaccgggaacggtaacggtcgttaacgtaacgttttaacgttaccgttaaccgtaacggtaaaaccgtaaggtaacgtaaacgtacgggttaaggaacgtttacccgtagttagggttacgggttcgggtacgggacggggtaaccggaccgtaacggtcccgttacggaacccggttcggttaacggtccggaacggtaccccggacggtaccgttccccggcccccgttaccggg

SEQ ID NO: 202461 - DNA, 694 bp, Homo sapiens
  misc_feature: GYAE6OF02IQECF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggcaggatcacctgctctgcagatggactgaccaaaagaatctgcttagttacggtaacaacaagaacgaccgaacggccgaacggtcccctggtagttagtagtataataagtaaacgactaacgtagaagacggccctacaagacgacttcccgagacgacgtacttctcgtggtctaccgacgcgtcgaaggacacgacgacgtcgtacgtagactatcgagttacgaagtaccgaggcgaaggacggacggtaggcgttagaaccttaattaaccgtagtaaccaaacgtaacggtaacgaacgtaaggtaacggtaacggttacgttaaccggttaaaggtttacggggttacgggttaccgggtacggggaacgggtaacccgtaacgggttaaccgtaccgggtaaccccgttaccgggtacggttaacccggacccggtaaacccggaacccgggtaccgttacccggaccccccggttaaccggg

SEQ ID NO: 202462 - DNA, 674 bp, Homo sapiens
  misc_feature: GYAE6OF02GJZBU.21.46.E02.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggccttcctatgagctgacacagcccaccctcggtgtcagtcgtccccaggacagcggccaggntcncctgctctgcagntggctgaccaaaagaaatntntnttattcgtaccaacagacgccgacggccgccggccctgttgttgtgatataataaanacacgtggaggaccggcccctcgagacgtcctccccgtacgacgtcgttactttccttccgttcggtcctcccncgtcgtccggacggggacgacgccgtacgttccgtacgttcgtacttattcgtagtacggtacgtccgacggcgacggacgggacggcggcgtacgttacttcgtttacgttacgtacgtaacgtaagtaagtacgtaggttaggtacggttacgttcgttaggtttggggtttcggggttcggggtcggggacgggaccggtacggtaccggttccggtacccggttccggttaccggtaccggtacccggtcccggtaccgggtcccggttccccggtccccccggtccccgg

SEQ ID NO: 202463 - DNA, 705 bp, Homo sapiens
  misc_feature: GYAE6OF02I9LJZ.21.46.E02.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagactcatctacaggaaaagggggtgggtccaggaggcagaactctgggtgtctcaccatggcctggatccctctacttctccccctcctcactctctgcacaggctctgaggcctcctatgagctgacacagccaccctggtgtcagtcgtccccaggaccaggacggccaggactcacctgctctgcaagntcggactgaccaaaagaatatgtactttagttacggtaaccaatagaacgaccgacggaccacggtccctggtacgttagtgaatataactaacgactacgtaggacgtacggcctagaagacgtacctccgtagacgcgttatttccgcgtacggcctacgagcctcgagggacagccgtagttccgtacggttacacgttaactacgtaggtacgaacgtaccgagggtaacgaggaacgggacgtagggttactacggtaacctttagttaaccgtagtaaacctaacgtaagtaccggtaaagtacgggttaagtacggttaaccgtttaggtacggttttacgggggtcggttaccggggtaccgggtaacgggtaaccggacgttaccggttaacccggtaccggtttacccggtagggacccgtaccggtacccggtaaccgggtccgttccccggtacccccgtttacggg

SEQ ID NO: 202464 - DNA, 657 bp, Homo sapiens
  misc_feature: GYAE6OF02I988Q.21.46.E02.1.454.CMB.1.raw
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
tcagtcgtcgctcgcacgaccggtgctcgatttagactcatctacagggaaagggggtgggtccaggaggcagaactctgggtgtctcaccatggcttggatccctctacttctccccctcctcactctctgcacaggctctgaggcctcctatgagctgacacagccaccctcggtgtcagtcgtccccaggacagacgccaggatcacctgctctgcagatggactgaccaaaagaatatgtacttattggtaaccaaacagaaagccgaggaccacggacccccgttgtcgttagtagacgtaatataaagaacactggaagnggtcccngtaagagactcccctaggacgacgtatttcctcgtgggcctaccgtacgtcgtacgaagggaccgagccagtccgtacggttgacttatctaggtacgtaacgtcgtaggacctagggtaacggacggaaggtacgtagtaacgttacttacgtacggtaacaaacgtaaggtaacgaaccgtaggtaacggtaacggtttacgtacgttaggttacggggttacgtttacggggaccgggtaagggtaccggaaagtccgtaggaccccgttacggtacggtacgtaccgacccgaaggtccgtacccgtccccgtacccggg

SEQ ID NO: 202465 - DNA, 586 bp, Homo sapiens
  misc_feature: GYAE6OF02I1W1L.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcactgctctgcagatggactgaccaaaagaaatatgtacttattggtaaccaaacagaacgccaggccacggcccctgtgttagtgatataagtaaagacactaggagacgcctacagacgactcccgtagagcgattcctctcggcctaccacgcgtacgaacgggtacgagactagtccgtaacgttgaacttatacgagtacgacgtccgaggcgaggacgacgaggtctagactaacttacgcgtaacaacgtagtaacgactaaggtaggtagttacacgtaggttcgggtacgtcgggacggaggaccgtaacggcgtcggtaccgtcggtacgtcgtacccgacgacggtacctcccggccccttaccggg

SEQ ID NO: 202466 - DNA, 722 bp, Homo sapiens
  misc_feature: GYAE6OF02G586S.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatcgagctgacacagccaccctcggtgtcagtcgtccccaggacagacggccaggactcacctgctctgcagatcggactgaccaaaagaatatgactttagttacggtaaccaacgaagaacgaccgacggacccgaccggccccttaggttacggttaaggtcggtaaacttaattaaaacgtaaaacgtaccgtacgtacggtaacgggaaccggtcccctaagaacggtaacgtacccttccccggaggtacgtacgttacgtttacgtcggtaccgtaccgtacgtcgacgtaccgggaaggaacgacgtacgtacgtaccgtagttacgacttacgtacggaagttacgaacggtcgaaagggaccgacggtaacgggacggtagcgttaacgtacgttaagtacttaggaaacctaagtacgtaacgaacgtaggtaacgtcggttaacttgggtaggtttcgggtacgggtacgggacggtaacggaccggtgtaccggtacggtacccgtaggtaacgaccggaccgaaccggtaccgggtccctaccggtcccgtaccgg

SEQ ID NO: 202467 - DNA, 662 bp, Homo sapiens
  misc_feature: GYAE6OF02IB1DO.21.46.E02.1.454.CMB.1.raw
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgacggccttcctatgagctgacacagcccaccctcggtgtcagtcgtcccaggacaggaccggcaggactcacctgctctgcagagtggactcgaaccaaaagtaatactgtactttagttacggtaaccaacaggaacgccacggccgaccggcccgttgtacggttagtgtaactaattaataaacgaactacgtagaagacggacctagagagactccgtagacgcgtacttccgtcgtcggacctcgacgtcgtacgagggtaacaggtacctaggtcgtaacgttacgacttaacgtacgtacggtacgtaacgtaccgaagggaacaagggacggacggtacggtctagtaactaacgttacgagtaaacaacggtaagtaacggtacaagggtaacggagttaacgtagtaggttaggttacggtacggacgggtaacggaacgtgtaccgtacggtacccgttacgtacggtacgaccggaaccggtaacggtccgttacccgtcccgtaccg

SEQ ID NO: 202468 - DNA, 709 bp, Homo sapiens
  misc_feature: GYAE6OF02FI55A.21.46.E02.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagactcatctacagggaaagggggtgggtccaggaggcagagctctgggaatctcaccatggcctggacccctctcctgctccccctcctcactttctgcacagtctctgagcctcctatgagctgacacagcccaccctcggtntcagtcgtccccaggacaaacggccaggatcacctgctctggatattcattcgaccaaaaagtatatacttgttcgttccagcagagtcaggccacggcccctgtacgtggtcatccgatggacgccagtccgacgactacgtccgggactcccgtagagacgtacttctcgtcgtccctccaggtcctacggaggggtactagggtcggaccctaccgtttcgaaccttagtccgagggtcggggtacccgaggggtcggaacgtagtacggaacgcgttacggtaacttacgttacgtttacggttaccgaccgaaccgaacggtacgtaggttacggtacggtactacggttacgggtaacgggggttacgttacggggacgggtacgggtaaccgtaacgggttaccggtacccgttccggttacggttccgaaccggtaaccccgtaacgggtcccgttacccggtccccccggttcggttacccgtacccgtttcccggtttacccggttcccccgtaccccccg

SEQ ID NO: 202469 - DNA, 748 bp, Homo sapiens
  misc_feature: GYAE6OF02JA0PC.21.46.E02.1.454.CMB.1.raw
  modified_base (262)..(262): a, c, t, g, unknown or other
  misc_feature (262)..(262): n is a, c, g, or t
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtggggtccgaggaggcagaactctgggtggtctcaccatggcctggatcctctacttctcccctcctcactctctgcacaggctctgaggcctcctatgagctgacacacgccaccgtcgtgtcacgtgtcccaggaccagaccggccaggactcaccgtcgctccttagcagacttcgggacttcggacccaaaagtaaacttntacggtacttattacggtaaccgaaccaagaaacgccgacggtccaaccggtcccccttggttcgttaagtacggataacgttaataaagtaaccgattcggaaacgtacgggccccttaacgacggaacgacgttaccccgtaggagaccgtacttcttcggtcgccttaccggngaccttacggacgggtaacgacgacctaacgtacgttacccggttagaccgttacgtacgtacggtacggtaacgttacggagtacgacgggaacggtacgggtacggtaccgtacggtaacttaccgtttacgtagtaaccgtaaacgtaacggttaaccacggtaagggttaacaacggggtttaaactaccggttaacgttggggttacgggttacgggacgggaacgggtaccgaaacggtcgtaaccgggtccgttaccggtaacgtaccgacgacccgaacgtccgtacccgtacccggtaccg

SEQ ID NO: 202470 - DNA, 728 bp, Homo sapiens
  misc_feature: GYAE6OF02I8XEG.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctcgtgacggcctcctatgagctacgacacacgcccacccgtggttgtaccagttccgtaccccgaaggacacggaccggaccaggactccaccgtgctctgcagtatcggactagaactaaaagaactagtacgtacttagttacgaaccaagagaacgaccgacggaccgacggtacccgtgtacgttagtagtaataaagtaacttaaaacgacctaacgtaggaacgtaccggccctaagaagacgtacctcgaggactcgtattcgtacgtcgtacctaccgaagtcgtacggaaacgggactacggtactacgtcgtactagaacttagacgtagtagtacgacgagacgtaagggaggtacggacggtactaacgtaccgttaattacgaacgtaacgtaaacggtaggtaacgtaaagtacggttaaaggtacgttacgtaacggttagggtttacgggtacgggtacggggtaccggaaacgggtaaccgacggtaccggttaccgggaaccgtttaacccggaggaaccccggtaacgtacccggaacggtccccgttacccgggtccccttaaccgg

SEQ ID NO: 202471 - DNA, 670 bp, Homo sapiens
  misc_feature: GYAE6OF02JQN0B.21.46.E02.1.454.CMB.1.raw
  modified_base (251)..(251): a, c, t, g, unknown or other
  misc_feature (251)..(251): n is a, c, g, or t
  modified_base (395)..(395): a, c, t, g, unknown or other
  misc_feature (395)..(395): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagacggccaggactcgacctgctctgcagatcggactacgaccaaaagtaaactntgtcttattacggtaaccaacaagaacgcaggaccgaccggtccctggtacgttagtacgtataataataaacggactaacgtggaagacgtaccctgaacgacgtactacccgtaggacgctacgttctacgtcgcgtaaccngtactacgagggtacagactacgtcgtacgttagactatcgaggtagacgtcgagacgaggaacggacggtagcgttacgtaacgttaacgttacgtacgaaacgttaaacgtaggtaacgtaaggtacgtaaaggttacgtaacgttaccgagggtttaacgggttacgggttaaccgggacgggtaacgggacgtaacggtccgtaacggtcccggtacgttaacggtacgaccggtaacccggtacgaccggttcccgtcccccgtaacggg

SEQ ID NO: 202472 - DNA, 604 bp, Homo sapiens
  misc_feature: GYAE6OF02HEQTU.21.46.E02.1.454.CMB.1.raw
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
tcagtcgtcgctcgcacgaccggtgctcgatttagactcatctacagggaaagggggtgggtccaggaggcagaactctgggtgtcctcaccatggcctggatccctctacttctccccctcctcactctctgcacaggctctgaggcctcctatgagctgacacagcccaccctggtgtcagttcgtccccaggaccagacggccaggatccacctgcctctgcagatggactgaccaaagaatntgacttattgaccaanagagccaggccacggccctgtgtagtnatatataagactagngagcgcctagaganctccgtagacgcgtattcgtcgtggcctcgagtcctagagggacacggctaacggtctacggttacactagtcgagtcgacgtccgaaggcgaaggaacggtacggacggtactacggtaacttaagttccgtacgtaactaaacgtaggttaacaacggtagtaacggtaacgttacgttcgtaaggttcgggttaggttccggtacgggaggtacccgacggtcgtaccggtacccgttacgtacgtaccgacggacccgaacggtccgtccgtcccccgtacg

SEQ ID NO: 202473 - DNA, 568 bp, Homo sapiens
  misc_feature: GYAE6OF02GGWT2.21.46.E02.1.454.CMB.1.raw
  modified_base (406)..(406): a, c, t, g, unknown or other
  misc_feature (406)..(406): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatatgcttattaggtaccaacagaagccaggccaggcccctgtgttagtgatatataaagacactgagaggccctcagagactcccgtgagcgattctctggctccagctcagggacagcagtcacgttgactatcagtagtaacgtccgaggtcgaggaggacgnggctagacttatacgtgtacaaacgtgtaacgacgtaagtaggacgttactagtacgtttgggtagtttcgggcgggaagggaccgaaggtccgtacgggtacccgtccgtaagggtccgacggacccgtaagggtcccgtcccggtccccccgttaccggg

SEQ ID NO: 202474 - DNA, 729 bp, Homo sapiens
  misc_feature: GYAE6OF02I2MQU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacacgcccacccgtcggtgtcagtcgtccccaggacacggaccggccaggactccacctgctctgcagatcggactcgaaccaaaagaaatagtcgtacttagttacggtaaccaacgaacgaacgaccgacggaccgaccggtccccgttggttacggttaggtagtaattaagttaaagtaaaacgaacgaacgtacggaacggacggtacccgtacgaacggacgtacgtaccgtacggacgtacgtacgttccttacgggggggggggggtctccgtaccgtacgtaccgtacggaacgggacgacgacgtacgtaccgtacgttacgtaactacgtacgtacgtacggtaacgtaccgacggacggaacggaacgggaacggtacggtacgtacgtaacgttaacgttaacgtacgtaacgaaacgtaagtaacgaacgtaagtagtacgtacgtacgtacggttagggttacggtacgggacggtacggaccgtaacggtacgtacggtaccgtaccgtacgtacgaccggtaccgacggtccgtacccgtcccgtccgg

SEQ ID NO: 202475 - DNA, 651 bp, Homo sapiens
  misc_feature: GYAE6OF02H6BQZ.21.46.E02.1.454.CMB.1.raw
  modified_base (135)..(135): a, c, t, g, unknown or other
  misc_feature (135)..(135): n is a, c, g, or t
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacnggctctgaggcctcctatgagctgacacagccaccctcggtgtccagtcgtccccaggacacggacggccaggactccacctgctctgacngatggactgacaaagaatcngtacttattcggtaaccaacaggaacgcaggccacggcccctgtagttacgtgactataataagacacgtgagacgctcagacgactccagacgtctattcgtcgtggcctccgacgtccgtacgacggaacacgtcacgtcgtacgtacgtactagacgtagttaggaacgttcgaacggacacggagggtacggacggtctacggtacttaagttacgtacgtaaccgaaacgtaggtaacgtaacggtagtaaggtacgttacgtacgttacgggtagggttaccgggtcgggtacgggaccggggtaaccaacgggtacctacgggtaacccgtttaccggtaggttcccgaacgggtaccccggttaacgggtcccgtacccggtaccccggttacccgg

SEQ ID NO: 202476 - DNA, 737 bp, Homo sapiens
  misc_feature: GYAE6OF02FMBZ0.21.46.E02.1.454.CMB.1.raw
  modified_base (315)..(315): a, c, t, g, unknown or other
  misc_feature (315)..(315): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaatatgacttatcggtaccaacagaagcctaggccaggccctgtcgttgtacgatatataaagcactgagacggccctnagagactccctaggagcgactttctacgtggtcctaccacggtctaccggaacggggtacgaacgggacccgtaacgggttacccaacgggttttacgaaccgtttaacgtacccggtaaagggttacgtaaaccgggtttaccccgaaaggggtccccgtaaaggggaacggggaaacccgggtaacggggtcttaacgggtaactttaaaccgttttaacttacgggtaaaccgaaacgttaacggtaacggtaacgttaacggggttaacgtaagggttaaccttaggtacggttttcgggggtacgtttaccggggacggggaacggggtaacccgaagggtccttacggggtacccgttccgtaaggttaccgaccggtaccgtaacggccgttaccccggaccccgtttacccggg

SEQ ID NO: 202477 - DNA, 749 bp, Homo sapiens
  misc_feature: GYAE6OF02IS10P.21.46.E02.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctagacacacgccaccctggtntcagtcgtccccaggacaggaccggcaggactccacctgctctgcagagtggactcggaaccaaaagtaattagtcgtactttagttcggtaacctaacgaagaacgaccgacggacccgaacggtcccccgttaggttacgtttacgtaggtaatttaaagttaacgtaaaacgacctaaccgttaggaacgggtaccggtacccttacgaaggtaacgtaccgttacccgtaggacgtacgtactttccgttacgtccggtactacccgacgtcctacggacgggaacgacgacgtacgtacgtcggtttacgacttagtacgtaggtaacgtaacgtacgacgacggaaggtaacgggagacggtactaacgtaccgttattaaccgtacgtaacaaacgtaggtaacgagtaacgggtaacgtaaggtttaccgtagttaggtttccggggttagttaccgggggacgggtacgggtaccggaaggtcccggttacgggaaccggtttccgtagggtacccaacggtcccggtaaccggtccggtacccggttaccccgttaccgg

SEQ ID NO: 202478 - DNA, 703 bp, Homo sapiens
  misc_feature: GYAE6OF02GFKUZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggaccaggacggccaggactccaccgtgcctctgcagatcggactcgaccaaaagaatatgtacttaattcggtaaccaaacgaagaacgcccgaacgggaccccgaaccgggccccccgttggttacggtttaggttacggtaattaacgtaaagttaaaaacgaactaaccgttagggaaacggtacggggtaccccttacgaaggtaacgtaacttcccccgtaggacgtccggtaacttttccgtcgtacggtcctccgagtccgttacggaggggtacacggccgtacgttacgacggttcgtactacgtcgtacggtagtaacggtaccgagggacgaagggacgacggacggcgtacgtaactagtttactacgtaaccaaacgagtacgagtaaggtagtagtactagtacgtttgggtgtacgggaggacggaccgtacggacgtcggtaccgttacgtaggtacacggtaccgacgggtcctcccggtcccgttacccgg

SEQ ID NO: 202479 - DNA, 636 bp, Homo sapiens
  misc_feature: GYAE6OF02F434N.21.46.E02.1.454.CMB.1.raw
  modified_base (267)..(267): a, c, t, g, unknown or other
  misc_feature (267)..(267): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagcccaccctcggtgtcagtcgtccccaggacaggacggccaggatcacctgctctgcagatggactgaccaaaagaaatatgtacttattaggtaaccaanaagaagccaggccacggcccctgtgttagtagatataataaacgactactaggagacggccctagagagactccctagacgcgtattctcgtcggcctcgagctacggacggaacagctagtccaagttcgactatgagtgaacgtcgagcaaggaggacggagcgtagtacttaattacgtacgtaacaaacgtagtaacgtaacgtaaggtacggaacgttaacgtctaagggtttcgggtcggtttaccggggcggggaacgggtaacccggaacggtccgtaccgggtaaccccggtttacgtaccgggttaccgaaccggaccccggtaacgggtcccgttaccccggaccccccggtttccgg

SEQ ID NO: 202480 - DNA, 761 bp, Homo sapiens
  misc_feature: GYAE6OF02IBNL4.21.46.E02.1.454.CMB.1.raw
  modified_base (164)..(164): a, c, t, g, unknown or other
  misc_feature (164)..(164): n is a, c, g, or t
  modified_base (179)..(179): a, c, t, g, unknown or other
  misc_feature (179)..(179): n is a, c, g, or t
tcagtcgtcgctcgcacgaccggtgctcgatttagactcatctacaggaaaggggtagggtccgaggaggcgagaactctgggtgtctcaccatggcctggatccctctacttctcccctcctcacctctctgcacagctctgaggcctcctatgagctgacanacgtccaccctggtntcagttcgtccccaggacacgacggccaggactcaacctgcctgtcgccagtacgtgggtaccacgaaccgaaaaagaaacttaacttcggtatttaagttaccggtaaccaaacgtaagaacggaccaacgggtccgaaccggtcccccgttaggttaggttacggtactaacgttaacgtaagttaaaaacgaacctaccggttagaaacggccggtcccgtacaaacggacgtaacttacccccgtagggctaccgtacgtttacctcgtacggtcctacccgagtccgtacggacggaaccgagtacctcgaacgtttaccggtgtaacctagtcgaacggttagaaccgtacggtaaggaaggtaacggaggaaccggcgttaacggttaccgtaactttacggttaacgtaaccgaaacgttaacggttaacgaaccgttaaggtacgtaacgttaccgttacgttggttaacggttcgggttagggacgggttacacgggttacgaacggtcgtaccgtaccgttcggaacccggtcgaaccgtcggtacccggtccgtacccccgtgtaacccg

SEQ ID NO: 202481 - DNA, 589 bp, Homo sapiens
  misc_feature: GYAE6OF02F8VNQ.21.46.E02.1.454.CMB.1.raw
  modified_base (260)..(260): a, c, t, g, unknown or other
  misc_feature (260)..(260): n is a, c, g, or t
  modified_base (424)..(424): a, c, t, g, unknown or other
  misc_feature (424)..(424): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttagttggtaaccaanagaagccaggccaggcccctgtgttagtgatatataaagacactagagacggccctagagagactccctagacgccgtattctcgtcgcctccagtctacgagggacacgcacgtcacgttgaacttagtcagtagtaacgtcgaggacgaaggtacggacggnggtctagtaacttattactacgtaacaaacgtaagtacgaagtaagtaaggacgttactacgtaggttgggttggttacggacgggaacggaccgtaaggccgttaggacccgttaccggtaggtaccgacggtacccgaggtcccgtacccgccccgttaccgg

SEQ ID NO: 202482 - DNA, 679 bp, Homo sapiens
  misc_feature: GYAE6OF02ILGKN.21.46.E02.1.454.CMB.1.raw
  modified_base (303)..(303): a, c, t, g, unknown or other
  misc_feature (303)..(303): n is a, c, g, or t
  modified_base (552)..(552): a, c, t, g, unknown or other
  misc_feature (552)..(552): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacctcggtgtcagtcgtcccaggaccagacggccaggatccacctgctctgcagagtggactcgaccaaaagaatgtcgactttagtacggaaccaagagaacgccacggcccgacggcccttggtcgttaagngtaattaacgtaaacgtaaaacggcctaacgttacgggaaggtaccggacccctagaacggtacgtaccttcccggttaaggacgtaccgttaactttcccgtcggtacggtaccctcgaacggtctacgggtaacgggactacggacgtaacgtacgtaccgttagtaccttagtacggtagtacggtaacgtccgaggacgaggacggacgagtcgtagtacttacttactgtaaacaagtgaacgngtaagtagtacgacttacgtaggttgggtcggtagggacggacggtacgaacgtccggtaacggtacccgtggtaaccggtccggaaccggtacccgtaagggtcccgttaccggtaccccgtacgg

SEQ ID NO: 202483 - DNA, 587 bp, Homo sapiens
  misc_feature: GYAE6OF02F8AN4.21.46.E02.1.454.CMB.1.raw
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgcctctgcagatggactgaccaaaagaatatgtcttattggtaaccaacagaagccaggccacggcccctggtgttagtgatataataaagacatgagcgcctnagnactcctgagcattctctggcctccagctcgacgggacagcgagtcacgttcgacttatcgaagtacggaactccgaggacgaaggacgggtacgaggtacgtagaacttagtttactgtaaccaaacgtagtacgacgaaggttaaggacgttactacggtagtttgggttcgtacgggacggaacgggacctaacggccgtacggtaacccgttaccgtaggtaccgaacggaccccgtaaggcccgttaccgcccccggttacgg

SEQ ID NO: 202484 - DNA, 541 bp, Homo sapiens
  misc_feature: GYAE6OF02GCI4T.21.46.E02.1.454.CMB.1.raw
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggcccctgtactggtcatccatgagccagtcgacgacactccgggatccctgagagtacttctctgccctccagctcgagggacaggtcggccctaccttgactatcgaggtcgggcccagggtcggacgatgaagctagacttactattgttacncacagacagtagtggtacagtcggtaggggttntcgggaggacggacctaggttcgaccggttcgtggtcacggacccgaggtcctccggccccgtggcctaccgtcgtcccg

SEQ ID NO: 202485 - DNA, 735 bp, Homo sapiens
  misc_feature: GYAE6OF02IDOUK.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgcagatggactgacaaaagaatntgtcttattcggtaaccaacgaagaacgccgacggaccacggtccccctgttcggttagtgaattataattaaaacggactacgtagaaggacggtcccctacgaacgacgtaacctccccgtaggaacggtaccgtaacttccgttcgtcgggtcctacccgacgtactacggaacgggacacggtactacgtaccgtacgttacgtaacttactacgtaacggttacgtaaccggttcgaacggtacggtaacggacgggaaccggtacgggtacctaacggttaacttaaccgtttaacgtacgtaaacctaaaacgtacggttaaacgaaccgtaaggtaacggtaacgtaacttcggtaaggtttgggttacgggttccgggacgggtaacgggtacccgtaaggtccgtacgggtacccgttaccggtacggtaccggtaccgacccgggtaacggtcccgttaccccggtacccccgtttaccggg

SEQ ID NO: 202486 - DNA, 745 bp, Homo sapiens
  misc_feature: GYAE6OF02INEYO.21.46.E02.1.454.CMB.1.raw
tcagtcgtcgctcgcacgaccggtgctcgatttagactcatctacagggaaagggggtgggtccgaggaggcagaactctgggtgtctcaccatggcctggatccctctacttcctcccctcctcactctctgcacaggctctgagcctcctatgagctgaccacacgccacccgtcggtcgtcgagtcgtccccgaggacacgacggccgaggtactcgaaccgtgctcgtcgccgagatacgggactacgaccgaaaaggaaatagtcggtacctttagttacggtaacccaaacgaagtaaacggccccaggaccccgaacggtcccccgttagggttacttaaggttacgtattaacgtaactaaacggtacaaccgtggaacgtacggcccttacgagtaagtctacccgtagacgtaccgtatttccgtcgttcgggaccttaccgaacggtccgtacggaacggggtaaccgtacggaccgtaaaccggttcgtaaaccgtttaggtaaccgttagttaccgaacggttacggtaacgtaccgtacgacgtacggaacgacggaaggcgtacgtaacgttattaacgtagtacgtaaacgtacgttaacggaccgtaagtagaacggttataccgtagttacggtacgggtttacggacgggtacggacggaacgtaccgacgttaaccggtaccgtaggaccgtacggaccgagtaccgtaccgtaccccggtacgg

SEQ ID NO: 202487 - DNA, 748 bp, Homo sapiens
  misc_feature: GYAE6OF02GAO8W.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggactcacctgctctgcagatcggactgaccaaaagtaaactagtgtctttattggtaaccaaacgagaaacgccaggacccaggccccctggtgttagtgaatatataaagacactgagagccctgagagactcccgtgagcgtaattccgtcgtcgggtcctaccgagtccgtacgaacgggacgaacggtccgaaggttaccgtaacggtttacgtaaacgtttaactaccgtaaagttacggtaaaccggtccgtaaacgggacgaacgggtaacgggacggaacgggttacgtacgttaaaccgtttaacgtttaccgtacgttaaaccgaaaacgttaaggtaaacggtaaccgtaaagggttaagggtaaccggtttaacgttacggttaacggttttcgggggttagttaccgggggtacgggaacgggtaacccgtaacggtaccggttaaccggtaccccgttaccggttaacgggtcccgtaaccgggccccgtaaaggtcccgttaccccggtcccccggtttacccggg

SEQ ID NO: 202488 - DNA, 770 bp, Homo sapiens
  misc_feature: GYAE6OF02G9UWR.21.46.E02.1.454.CMB.1.raw
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagaccggccaggatccacctgctctgcagatggactcgaccaaagaactntcgtcttagttcggtaccaacagaacgccaggccgacggcccctagtcgttagtgtactaagtaacttaaacgacacgtaggaaggacggaccccttagacggaacgacgtcccgtaggtacgccgtaactttccgtccgtcgggtcctacccgaaggtccgttacggacgggacgtacgaccgtaggtaccgtacggtttacacggttaactcgtacggtacggtaaacggtccgtaagggaccgtaacgggtaacgggaaccgggtaacgggtccgtaacggttaaaccgtttaaacgtttaccggtaccgttaaaccgtaaaaccgtaggttaaacggacgtaaaggtaacgggttacggtaaccgtttaacggtaggtttacgggttacgttacgggggaccgggtaacggtaaaccggtcggtaccgttaccggtaaccccgggtttacccgttaagggtaccccgtaacggaccccggttaacggtccccggttacccggtccccccggtttaacccggg

SEQ ID NO: 202489 - DNA, 249 bp, Homo sapiens
  misc_feature: GYAE6OF02JCJOJ.21.46.E02.1.454.CMB.1.raw
  modified_base (157)..(157): a, c, t, g, unknown or other
  misc_feature (157)..(157): n is a, c, g, or t
  modified_base (234)..(234): a, c, t, g, unknown or other
  misc_feature (234)..(234): n is a, c, g, or t
  modified_base (240)..(249): a, c, t, g, unknown or other
  misc_feature (240)..(249): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttcccctggcgccctgctccaggancacctccgagagcacagcggccctgggctgcctggtcaaggactactccctgtctctactgagcggctggcaaggcncatagnnnnnnnnnn

SEQ ID NO: 202490 - DNA, 744 bp, Homo sapiens
  misc_feature: GYAE6OF02HQ9C7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctctatgagctgacacagcccaccctggtgtcagtcgtcccaggacagacggccaggatccactgctctgcaagagtcggacctcggaaccaaaaagtaacttagtagtactttagttacgtaaccaaagaacgaacgaccgaacggtccgaaccggtcccccgtggttagttacgtagtaataattaaacgtaaaaggacctaacgtacgaacggaccggtcccctaagaaacggtacgtaacgttccccgtaggaccgtaccgttaacgttccgttacggtaccggtccttaccgaactcggtaccggaacgggaaccgtacggacctacggttacgttaccgtttacggtaacttacgtacgtaacggtacgtaaaccggtcgaacgggacgtaacgggacggaacgggaggtacttacggtacttaagttaaccgtggtaaactaagacgtagtacgaagtacggtacgtactcgtaggttgggttacgtacgggacgggtaacggaccgtacgggtaccgtaccggtaaccgttaccggtacggtaccaccgggtaccggtaacggtcccgttaccccggcccggttaacccg

SEQ ID NO: 202491 - DNA, 621 bp, Homo sapiens
  misc_feature: GYAE6OF02F8RMN.21.46.E02.1.454.CMB.1.raw
  modified_base (293)..(293): a, c, t, g, unknown or other
  misc_feature (293)..(293): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggcaggatcacctgcctctgcagatcggactgaccaaagaaatatgtcttattggtaaccaacagaagccgaggccacggccctgtcgttagtntatataataaagacactgagtacggcctacgagacgactcccgtagacgcgtattctcgtggtcctccacgcctacgaacggggaccaggcgacgttacgtaacgttacggaaccttagtacgaggtacgtaaacgtccgaaggacgaaggtaacgggacggacggtcgtagtaacgtaacttacgtcgtaacaaagtagtaacgaacgaggtaagtacggtactacgtaggttagggtcggttaccggacgggacggaaccgtacgtacgtacggtaccgtacgtacggtaccgtacgaccgtacggacctccggtaccccgtacgg

SEQ ID NO: 202492 - DNA, 267 bp, Homo sapiens
  misc_feature: GYAE6OF02GRPDV.21.46.E02.1.454.CMB.1.raw
  modified_base (159)..(159): a, c, t, g, unknown or other
  misc_feature (159)..(159): n is a, c, g, or t
  modified_base (245)..(267): a, c, t, g, unknown or other
  misc_feature (245)..(267): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggccgccctgctccaggancacctccgagagcacagcggccctgggctgcctggtcaaggactacttccctcgtctctactgagcgggctggcaaggcgcatagnnnnnnnnnnnnnnnnnnnnnnn

SEQ ID NO: 202493 - DNA, 731 bp, Homo sapiens
  misc_feature: GYAE6OF02HNRNS.21.46.E02.1.454.CMB.1.raw
  modified_base (254)..(254): a, c, t, g, unknown or other
  misc_feature (254)..(254): n is a, c, g, or t
  modified_base (356)..(356): a, c, t, g, unknown or other
  misc_feature (356)..(356): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctctgacggcctcctatgagctgacacagcccacccgtcggtgtcagtcgtccccaggacagacggccaggactcacctgctcgtgacagagtggactgaaccaaaaagaaatntgtactttaagttacggtaaccaaacgaagaacgccgaacggaccgaacggccccgtgtagttagagtaataataataaaagaacactagagacgcccgtanagagactccgagagtcgacttcgtcgtacgctaccgacgtcgtacggaacgggtaacgaacgactaacggttctaacggtttacgtaacttaacgtacgtaagtaacggtaaacggtaccgaacggacgaacgggaacgggaacggaggttacgttacgtaacgttaattaccgtagttaaaccgaaaacggttaaacggttaaacaacggtaaacgtaaggtaacggttaaccgttacgttagggtttacgggttcgggttaccgggaccgggggaacggtaacccggaacgttccggtaaccggtacccggttaacgtacggggtaaccacggtaaccccgaaggtaccccgtccgtaccccccggttaccgg

SEQ ID NO: 202494 - DNA, 636 bp, Homo sapiens
  misc_feature: GYAE6OF02FVTBD.21.46.E02.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
  modified_base (325)..(325): a, c, t, g, unknown or other
  misc_feature (325)..(325): n is a, c, g, or t
tcagtcgtcgctcgcacgaccggtgctcgatttagactcatctacagggaaaggggtgggtccaggaggcagaactctgggtgtctcaccgatggcctggatccctctacttctccccctctcactctctgcacaggctctgaggcctcctatgagctgacacagccacctcggtgtcagtcgtccccaggacagcggcaggatcacctnctctgccagagtcgactgaccaaagaactntgcttattggaccaacagacgaccagccaacggcccctagtacgttagtgaactagtaataacgacactagacgtacggccctanagaactcgtccctagacgtcgacttctcgtcggccttacacggtcacgtaggggactagacgtacgttacacgttagtaactactcgaagtacgaacgtccgtaaggactaggaacggacgtggtacctacgggaacttagttaccgtagtaaccgtaaacgtaggtaacgtaaccgtaggtaacgtacgttaaccggtactacggtttaagggtcgttacgggtacggaccggtaacccgacggtacctacgggtaccgttacggtacgacggtaccgaccggtaagcccgtaccggtcccccgttacgg

SEQ ID NO: 202495 - DNA, 748 bp, Homo sapiens
  misc_feature: GYAE6OF02GDNH6.21.46.E02.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctagcacaggctctgaggcctcctatgagctgacacagccaccctcggtgtcagtcgtccccaggacagaccgccaggatcacctgctctgcagntggactgaccaaaagaatatgtctttattggtacctaacgagaagccaaggccaggcccctgtcgttagtgactataacttaaagacacttggagacgggtcccctagaacgtagacttcccgtggacgtcgtaacttcctcgtcgggacctaccacggccttacggaacggggtacctacggacgtaacggttaccgaaccggtttacgaacctttaaccgtcgtaaggttacggaaacgttcccgaacgggtacaggaacgggtaaccggaacgggcgtacgtaaccgttagttaaccgttaggtaaccaaaacgtaacgtaacggtaacgtaacggttaacggtaacggttaacgttaaccggtacggttttaggggtaccgtttccggggtaccgggtaacgggtaacccgtaaacgggtaccggtttaacgggtaaccccggttaccggttaaccggttacccgaaccggtaccccggtaaaccgggtaccgttacccggaccccccgtttaacccggg

SEQ ID NO: 202496 - DNA, 746 bp, Homo sapiens
  misc_feature: GYAE6OF02IRE8H.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggccttcctatgagctgacacagcccacccgtcgggtgtcagtcgtccccaaggacaggaccggccaggactccacctgctctgcagctggactgaccaaaaagtaatagtcgtacttagtttacggtaaccctaaacgaagtaacgacccgaggtccccgacgggcccccttggttaggtttaggttacgtaagtaattaagttaaaacggacacgtaggtaaggaccggcccttacgaagacgtaaccttcccgaggtaacgcgttagtttccttccggtcggtcctaccacgtccgtacgaacgggacacgacctagtaccgtacgtttacggaacttacgtaactacggaacggtacgtaccggtaaggacgaagggaacgggaaccgagggtactgttaaccttaactttacgtacgtaacgaaacgtacggtaagaacgtaacggtaagtaacggttaacttacgttacggtttgggtacggttcggggacggggtaccggaaccggtaacggttaccggtacggtacccggttacggttaacggtaccgaccggtaccgtaaccgggtccgttaccccggccccggttacccgg

SEQ ID NO: 202497 - DNA, 253 bp, Homo sapiens
  misc_feature: GYAE6OF02G5JZS.21.46.E02.1.454.CMB.1.raw
  modified_base (245)..(253): a, c, t, g, unknown or other
  misc_feature (245)..(253): n is a, c, g, or t
tcagtcgtcgctcgcacgaccggtgctcgatttagactcatctacagggaaagggactggagtggttattattcctggggccagggaaccctggtaaccgtctcctcagcctccaccaagggcccatcggtcttccccctggcgccctgctccaggagcacctccgagagcacagccggccctgggctgcctggtcaaggactacttccctcgtctctactgagcgggctggcaaggcgcatagnnnnnnnnn

SEQ ID NO: 202498 - DNA, 697 bp, Homo sapiens
  misc_feature: GYAE6OF02GE3KC.21.46.E02.1.454.CMB.1.raw
  modified_base (260)..(260): a, c, t, g, unknown or other
  misc_feature (260)..(260): n is a, c, g, or t
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtccccaggacaggacgccaggatcacctgctctgcagatggactgaccaaaagaaatatgcttatggtaaccaanagaagccaggccacggcccctggtgttagngatataataaagacactagagacggccctnagagactccccgtgagccgtaattctcgtcggctacccgagccgtacgaaggggaccagtcgacgtccgtaacgttagtacgtacgtacgagtacgaacgttccgaagggtcaaggaacgggtacggaggtcctaagtaaccttaagttaaccgttagtaacccaaaacgtacggtaaaggtaacgtaagggttaacggtaaaggtttaccgttaacgtaacgggtttacggggtttacgggttacgggggtaccgggtaacgggaaacccggtaagggtaaccgtacccgggtaacccggttaccggttaacgggtacccgtaccggtaacccggaacgggtccccggttaccggacccccccggtttaacccggg

SEQ ID NO: 202499 - DNA, 531 bp, Homo sapiens
  misc_feature: GYAE6OF02FQWVR.21.46.E02.1.454.CMB.1.raw
  modified_base (320)..(320): a, c, t, g, unknown or other
  misc_feature (320)..(320): n is a, c, g, or t
  modified_base (471)..(471): a, c, t, g, unknown or other
  misc_feature (471)..(471): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgcttattggtaccaacagaagccaggccaggcccctgtgttagtgaatataataaaagacactagacgaggcccctnagagactcccgtgagcgattctcgtgcctccagctcgagggacagcagtcacgttgaactatcgtagtagaacgtccgaggcaggaggacgaggctgacttatacgtagtacaagagtagactagtagacgttactcgagttggtgtcggnggaggacctaggctaggtaccgtcgtaggtcgacgacccgaggcctaccgccccgtacgg

SEQ ID NO: 202500 - DNA, 527 bp, Homo sapiens
  misc_feature: GYAE6OF02GEON0.21.46.E02.1.454.CMB.1.raw
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (389)..(389): a, c, t, g, unknown or other
  misc_feature (389)..(389): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctcggtgtcagtgtccccaggacagacgccaggatcacctgctctgcagatggactgaccaaaagaatatgcttattggtaccaacagaagccaaggccaggccccctgtcgttagtgatatataaagacatgagagccctnagagatcccctgaagcgtattcnctggctccagctcgaggacagcagtcagttgactatcagtgagtcaggcagnggacgagcngactntactgtacaangtaagacgagtaagaggttactcagttggtgttcgggaggacggtacgaacggctaggtacccgttcgtaggttaccgacggtccccgaagtcccgtaccgccccgttaccgg

SEQ ID NO: 202501 - DNA, 601 bp, Homo sapiens
  misc_feature: GYAE6OF02H9359.21.46.E02.1.454.CMB.1.raw
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacccctggtgtcagtcgtccccaggacaggaccggccaggatcacctgctctgcagatggactgacaaaagaatatgtcttattcggtaaccaacagaagccaggccaggcccctgtgttagtgactatataaaagacactgagacggccctanagaagactcccgtagagcgtatttcctcgtggcctccagtctcgacgggtaacagcgtacgtcgtaacgttgaacttatacgagttacggaaacgttccgaggcgaaggagggacgaggcgtagtacttaagttaactggtaaccaaacgtaggtaacgataaggtaggagttacgtctaggttgggttaggtcggacgggacggacgaacgtcgtaccggtaccgttccggtacggtcgaaccggtcccgaaggtcccgtacccgtccccgttcccgg

SEQ ID NO: 202502 - DNA, 802 bp, Homo sapiens
  misc_feature: GYAE6OF02HYF9S.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccacccgtcggtgtcagtcgtccccgaggacagaccggccaggactccacctgctctgcagatggactcgaccaaaagaatatgtctttaagttacggtaaccaaagaggaacgccgaacggacccgaccggtcccccttggttacggtttagtagaacttaagttaaagtaaaacgacctaacgtaggaacggtaccgggaccccttacgaacggaacgtaccttaccccgtaggacggtccgttaatttcccgttaccgtcgggtacccttaccgaacggtccgtacggacggggaacctacggacctaacggttaccgtaccggttacgtaaccgttagtaccgtaacgggttacgtaaaccggttccggaacggtacggaaacgggtaccgggaaaccggtacgggtaccgttagaaaccggtttattaacgtacgtaaaccgaaacgttaggtaagacgtaaggtaagggtaaccgtacgtttacgtaaggtttcgggtacggttaccgggacgggtaacggaacccgtaagggtcccggttaaccggtacccggttaccggttaacggtccccgaaccgggtacccccggtaacgggtccccgttaccccggtcccccgttaacccggg

SEQ ID NO: 202503 - DNA, 662 bp, Homo sapiens
  misc_feature: GYAE6OF02I2VT7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatggagctgacacagcccaccctggtgtcagtcgtccccaggacaggacggccaggactccacctgctctgcagatggactgaccaaaagaatatgtacttattacggtaaccaagagaacgccgaggccacggccctgtcgttagtgaatataagtaaagactacgtagagacgccctagagacgtctcccgaggacgtcgtatttccgtcgtcggtcctacacgtcgtacgaacgggactacgcgtacgtacctacgttagacttacgtacgaggtacgaacgtccgaggacgaagggacggacggtaggtctaggtaaccttagttaccgtagtaaccgtaaagaagtaacgaacgtaagtaaggtacggttaactacggtaggtttggggttaccggtacgggaccggggaacgggtaaccgaagggtccgtaacggtacccggttacggttaacgtaccgaccggtacccgtaacgggtcccgtacccggtcccccgttaccgg

SEQ ID NO: 202504 - DNA, 610 bp, Homo sapiens
  misc_feature: GYAE6OF02JJFE6.21.46.E02.1.454.CMB.1.raw
tcagtcgtcgctcgcacgaccggtgctcgatttagactcatctacagggaaagggggtgggtccgaggaggcagaactctgggtgtctcaccatggcctggatccctctacttctcccctcctcactctctgcacaggctctgaggcctcctatgagctgacacagccaccctcggtgtcagtgtccccagaccagacggccaggatccacctgctactgcctagatggactgacccaaagaatatcgacttagttcggtaacaacagaaacgccaggccacggccccttgtcggttaagtgagtaactaataaaggaacctacgtagacggacggaccctacgaacgagactacccctaggaacgccgtaatttccacggttgaccgttccaacggtcctcgtaagggaccctaaggaccacggttacaccgttgaactactacgacgtaggactacgaggtacgaagaggcgagtctacgacgtagtactgtacaaacgtcgtaagacgagtaaggtagtactagagttcggtagtcgggtacgaggacgtacggcgtacggtaccgtcgtagtacgacgtaccgacggtacctccggtacccctcgg

SEQ ID NO: 202505 - DNA, 712 bp, Homo sapiens
  misc_feature: GYAE6OF02HQD84.21.46.E02.1.454.CMB.1.raw
  modified_base (178)..(178): a, c, t, g, unknown or other
  misc_feature (178)..(178): n is a, c, g, or t
  modified_base (344)..(344): a, c, t, g, unknown or other
  misc_feature (344)..(344): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgacggcctcctatgagctgacacacgcctaccctggtntcagtcgtcccaggacagcggcaggctcactgctctgcagtatggactgaccaaagtaatagtagtacttagttacggtaaccaacgtagaacgaccgacggtacccgaacggtcccctaggttaggtacgtgaatactaataaacgctagagtacgacgtcctanaagagctcctagactcgtacttcgtacgtggacctcaggtcctacggacgggtacaggtcctagtaccgtacgttacgaacttacgtacgaaaggttacgaacgtcgaacggtaccgaggtaacgggaccgaggtccttaaggtactttaacgttacgtaacggtaaaccgtaaaagtaacggtaagtaaacgtacggtaacggtaacgttaccgttcggttaaggttcgggggttaacgttaccggggacgggttaacggtaaaccggtacgtcccggtaacggttaaccccgttacggttttaaggtacccgtaaccggtaacccggtacggttacccggtttcccccgggacccccgttttacgg

SEQ ID NO: 202506 - DNA, 791 bp, Homo sapiens
  misc_feature: GYAE6OF02H01DP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggactcacctgctcgtgcagatggactgaccaaaagaatgtgtacttagttacggtaaccaacgaagaagaccgacggaccaccggacccccgttgtacggttagtagtaataagtaataaaacgactagtcgaagacgcccgtagacggagactacccgtggacgtacgtacttccgtacgtcggtctaccgtagtaccgtacgacgggaacgacgaccgtacgtaccgtacggttacgaacttagtaccgtaaggttagaaaccggttaccggaacgggtacgaagggtacgggaacggaagggtaccgtagggttaaactttactttaaccggtagtaaacccgtaaacgtaacggttaacggaaccggtaaacggttaacgggtaaacgggtttaacccgtcggttaaacgggtttttaggggttccggggtttaaccggggaccgggggttaacgggtaaccccggtaaacgggttcccgtaaccgggtaacccgggtttacccggaacgggtttacccggaacccggtaaccccggaaccgggttaccgtaccccccgggttacccccgttaacccggg

SEQ ID NO: 202507 - DNA, 845 bp, Homo sapiens
  misc_feature: GYAE6OF02HZ66U.21.46.E02.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcanaggctctgaggcctcctatgagctgacacagcccaccctcggtgtcagtcgtccccaggacagacggccaggatacacctgctctgcagatggactgaccaaaagaaatatgtactttaagttcggtaaccaaacaagaacgaccgaggccacggccccgtgtacgttagtagtataatagtaaaagactacgagaggacgccctcaagagtacctaccgtagacgacgtacttccgtacgttcgggacctaccgacggtacgtaccggaagggggacctaacggaccgaaggttacccgtaacgggtttacgtaaccgttaacgtacgtaaacggttaacggtaaaccgttaccggaacgggtaccgaaaggggtaaccggggaacggtaacgggtaccgttacgtaaacgttttaacctttaaacgtaccggtaaaccgtaaaacgtaacgggttaaacggtaaacgtaaaggtttaaaggggtaaaccgtttaaccttacgggttaaggttttaacgggggttccggggtttaaacccggggtacgggggaacccggggtaaacccggtaaggggttaaccccgttaacgggggttaacccccggtttaacccggttaaccgggggtaacccgtaaacccggggaaccccccggttaaacgggggtcccccgtttacccccgggtacccccccggtttacccccggg

SEQ ID NO: 202508 - DNA, 1087 bp, Homo sapiens
  misc_feature: GYAE6OF02F5CLW.21.46.E02.1.454.CMB.1.raw
  modified_base (179)..(179): a, c, t, g, unknown or other
  misc_feature (179)..(179): n is a, c, g, or t
tcagtcgtcgctcgcacgaccggtgctcgatttagactcatctacagggaaagggggtgagtccaggaggcagaactctgggtgtctcaccatggcctggatccctctacttctccccctcctcactctctgcacaggctctgaggcctcctatgagctgacacagcccaccctcggtntcagtcgtccccaggacacggacggccaggactccacctgctctgcagagtggactcgaaccaaaagaatagtcgtactttagtttacggttaaccaaacgtaagaaacggtacccgaacgggaccccgtaacgggtccccccgtttaggtttacgggttttaacggtaggtaaattaaacgttaaacggtttaaaaacgaacccgtaaacgttacgggaaacggtacccggggtaccccttaacgaacggtaaccggtaacccgttacccctacgggtaacggtacccggttaacgtttttcccgtaccggtttaccgggtaccccgtttacccggaaccggtacccgtttaaccggggaaaccggggtaaccggtaaccgggtaccgttaaccgggtttaccccggttaaccgggtttaaccgggtaaaccttaacgtttaaccggtaacgggtttaaacgggttaaaccccgggttaacccgggaaacgggttaacccgggaaacgggggttaaacccggggaaacccgggggtaacgggtttaacccgggttaacggttaaaccccgtttaaacggttttaacccgtttaacccgggttaaaacccttaaaaaccgggttaaacggttaaaccggtaaacccggggtaaaggttttaacccggggtaaacgggtttaaccctttagggtttaaacccggggttttaggggggttttacccggggtttacccgggggggtaacgggggttaacccggggtaaacccggggtaaacgggttacccccgggtaacccgggtttaacccccgggttaacccgggtttaaccggttaaccccgggtaaaccgggacccccgggtaacggggtttacccccggtaacccccgggtttcccccccccgggg

SEQ ID NO: 202509 - DNA, 905 bp, Homo sapiens
  misc_feature: GYAE6OF02G8EXY.21.46.E02.1.454.CMB.1.raw
  modified_base (208)..(208): a, c, t, g, unknown or other
  misc_feature (208)..(208): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggntccacctgctctgcagatggactcgaaccaaaagaaatagtgtactttaagttacggtaaaccaaacgacgaaacggacccgacgggacccaaccgggtccccccttaggttacggttttaaggtaggtaaactttaagtaaaagttaaaaaccgaaccaaccgttaggaaacgggtaccggtaccccgttacaaggtaacgtaaccgttccccgttaggacggtaccgttaactttcctcggtcggtacctacccgtaagtcccttaacggaacggggtaaccacggtaccaacggtttcccgtaacggtttacgaaccgtttaacgtacccgtaaagggttaccggtaaaccggttaccgggaaacgggtaccgtaagggaaaccgggaccggttaaccgggaccgtttaacggttaacccgtttaaacgttaaccgttacggtaaacccgtaaaagttaacggtaacgtaaacggttaaaggttaacgggtaaccgggttaccttacgggtttaaacggtttcgggggtttacgggttaccgggggaccgggttaaacgggggaacccctaacggggtcccggttaccggtaacccccgggtttaaccgttaaccgggggtttacccgaaacccgggtaaccggttaaccccggggtaccctttaccccccgggtaaccccccggttcccgggg

SEQ ID NO: 202510 - DNA, 647 bp, Homo sapiens
  misc_feature: GYAE6OF02G0QM4.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacacgacggccaaggatccacctgcctctgacagatgactgaaccaaaagtaaactntagtacttagttacggtaaccaagaacgaacgccgaggccacgcccctgtagttagtagataatataaacgacacgtgaagcgcctacagagactccgtagagtcgtattctcgtacgtcctacgtacgctacgaaggacacgcagtactacgttacgacttactacgagtagtaacgtcgaggacgaaggaacggaccggaggtacgtacgttaacttagtttaacgtacgtaactaaacggaagtaacgtaacgtaggtaacgtaacgtacgttacgttacggttaagggttcgttacgggacgggtaacggaacgtacggtaccgtacgtacccggttacgtaacggtccgaaccggaccggtaaccggtacctcccggtaccccgttaaccgg

SEQ ID NO: 202511 - DNA, 716 bp, Homo sapiens
  misc_feature: GYAE6OF02H6UGE.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctgacacacgcccacccgtcggtgtcagtcgtcccaggacaggacggcaggactcaccgtgctctgcgagagtgggactcggaaccaaaagtaaatagtgtactttagttacggtaaccaaacgaagaacgccgaacggacccgacggtccccttaggttacggtttaagtacgtaataataaagtaaaacgtaccaacgttaggaacggtacgggtacccctacgaaggaacgtaccgttacccgtaggaacgtcgtacttccgttacgtcggtcctaccgagtccgtacggaacggggactacggtcgaacgtacgtacgttacgaacttacgtacgtaaggttacggaacgtacggagaaccgaggagggacggacggtcgttagtaacgttattaacgagtaaacaacgtagtaacgtaacgtaaggtacggtaacgttacgtacgttaggtagggtttacggtacgggacgggtacggaacggacgtccggtacggacccgttacgacgggtcgaaccggacccggtaacggtccgttcccggaccccgttcccgg

SEQ ID NO: 202512 - DNA, 597 bp, Homo sapiens
  misc_feature: GYAE6OF02I1HUI.21.46.E02.1.454.CMB.1.raw
  modified_base (353)..(353): a, c, t, g, unknown or other
  misc_feature (353)..(353): n is a, c, g, or t
  modified_base (420)..(420): a, c, t, g, unknown or other
  misc_feature (420)..(420): n is a, c, g, or t
  modified_base (432)..(432): a, c, t, g, unknown or other
  misc_feature (432)..(432): n is a, c, g, or t
  modified_base (441)..(441): a, c, t, g, unknown or other
  misc_feature (441)..(441): n is a, c, g, or t
  modified_base (455)..(455): a, c, t, g, unknown or other
  misc_feature (455)..(455): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgaacacacgcccaccctcggtgtcagttcgtccccaaggaccacgaccggtccaaggactccacctgtctctgcagtagtggactagaaccaaaagtaatatgtacttattcggtaaccaacgtagaacgccgagccgacggtcccctagtcgttagtgtagtaataataacgacactagagacggtccctanagactactccgtgacgacgtacttctcgtcgtcctacagctacgaggacagacagtacgtacgttanactatcgaagtnaagtcaggnaggaaggacgagtntagtacgtatactacacgtaanaggtanaacgtagtacgagtctagtaggttgggtgtcggggacgtacggaccgaggtccgtacggtaacctaccggtaggacaccggtaccgaacggtcccgtccgtaccccgttaccgg

SEQ ID NO: 202513 - DNA, 576 bp, Homo sapiens
  misc_feature: GYAE6OF02H9019.21.46.E02.1.454.CMB.1.raw
  modified_base (404)..(404): a, c, t, g, unknown or other
  misc_feature (404)..(404): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgcttattggtaaccaacgagaacgccaggccaggcccctgtcgttagtgatatataaagacactgagacggccctgaagagactacccgtgagcgattctctggctccagctcgaggacagcagtcgacgttgactactcgagtagaagtccaggcaaggnggaacgaggctgaacttattactgtacaaacgagtaagacaagttacggagtacgtacgtggttagggttgttcgggacgggaacggtaccgtaaggtccgttacggacccggttaccgtacggtaccgacggaccccgtaagggcccgttacccggcccccgttacccggg

SEQ ID NO: 202514 - DNA, 761 bp, Homo sapiens
  misc_feature: GYAE6OF02F9FTH.21.46.E02.1.454.CMB.1.raw
  modified_base (244)..(244): a, c, t, g, unknown or other
  misc_feature (244)..(244): n is a, c, g, or t
  modified_base (334)..(334): a, c, t, g, unknown or other
  misc_feature (334)..(334): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccgggacaaaccggccaggactcaccgtgctctggagatgcattgaccaaaaattnttgtttttcggaccagcagtaagtcaggccaacggccccttggtgttggtcatccatggagacaggacacggacccgtcgggactcccgngagacgtagttcctcgtcggcttaccaacgtcggaacgggtccgggtcgacccgtacgttagactttcgtcgtagggtcgggacccgtagggtgggaacggtagtagaacgtcgtacgaccgttacgtaccttaggttaaccctcgacgacgtaacgacgttacgacggtacgtaggtaccgacggttcggaacggggggtacctaggggtttacccggggacgggtaaccgggggtaaccttacgggggtttacccgtaaccccggggtttacccgggtacggttacccggaacccggggtaccccggtaaaccgggttcccgttaccccgggacccccccgtttaggggttaccccgttacccgtttaaccccggtttccccggttaacccccttaccccccggtttcccgttttcccccccggg

SEQ ID NO: 202515 - DNA, 716 bp, Homo sapiens
  misc_feature: GYAE6OF02FYRUI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccacccgtcggtgtcgagtcgtccccaggacagacggcaggactcacctgctctcgcgagatcggactcgaaccaaaagaaatagtcgtactttagttcggtaaccaacgtaagaacgccgacggccaacggtcccgttgtacgttagtgacgttaagtaacgtaaacgactacgtagacggaccgccgtacagtacgtactccgtgacgcgtacttactcgtcgcctacgcgtacgtcgacgggacagacgtacgtacgtacgttacgtactacgtactaaggtcgtacggtacgtacggacgtaagggacggtacggacggtacgttagtaacgtttacttacgtacgtaaactaaacggtaacggtacgtaaccgtaagttaacggtaacgtttaccgtaagttgggtttacgggtacggtttcggggaccgaacggggtaccgtaacggtaccggtaccgggttacccgttacgggttaaaccggtccggtacccggtaacccgggtaccggtaccccggttacccggtaccccgtttacccggg

SEQ ID NO: 202516 - DNA, 739 bp, Homo sapiens
  misc_feature: GYAE6OF02I89ZM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctcctatgagctagacacagccaccctcggtgtcagtcgtccccaggacagacggccaggatcactgctctgcagatggactgaccaaaagaatatgtacttagttggtaaccaacagtaacgaccgaggcccaacgggcccccttaggtagttagtagaacttaagtaacgttaaaacgacgaaccgttagaaacgggaccggcccccgttagtaacggaactaaccgttccccgtaaggacgggtacccttaatttccgtaccgttcggggacccttacccggaaagtcccggtagaacggggaaccacggtactaacgtaccgtaaggtttcctaacgttacgtacgtaaggttacggaacgttaccgaaggtaccgaaggaaccggggtaacgacggtacgtaacgtaacgttaacgtttaccgttaacggaacgttaaaacgtacgtaaacggaaccgtaagtaacggtaaggtacctacgtaggtttcggttaggtaccgggtcgggaacggtacggaacgtccggtcggaaccggttaccgtaaggtcctacgggaccctagggccctaccggtcccccgttacgg

SEQ ID NO: 202517 - DNA, 607 bp, Homo sapiens
  misc_feature: GYAE6OF02FJFCH.21.46.E02.1.454.CMB.1.raw
  modified_base (329)..(329): a, c, t, g, unknown or other
  misc_feature (329)..(329): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgcttattggtaaccaacagaagccacggccgacggtccccctgtggttagtgataataataaagacataggaggacggccctanaaggacgactccccgtagacgtacgtactttcgtcgtggtccttccgaacgtctcgaacgggacaagctaaggtctacgttagactatcgagtagaacgtccgaggcgaggaggacgaggctagtacttattacgtacgtaaccgaaataggtagaacgtaagtagaacggttaactcgtaggtttgggtcggttcgggacgggtacgggaccgaacggcgtacggtaacccgtcgtacgacgaccggacccgtaaggccgtcccggcccccgttcgg

SEQ ID NO: 202518 - DNA, 743 bp, Homo sapiens
  misc_feature: GYAE6OF02F7MGX.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgagcctcctatgagctgacacagcccacccgtcggtgtacagttctccccgaggaccagaccgccgaggatccgaacctgccttcgtcgacgacgtagtgggacctcgaacccaaaagtaaactatcgactttagttacggtaaccaacgaaggtaacgaccgacggaccgaacggtcccctaggttagttacgtaggtaactaattaataaaacgacctagttacggaagtacgggtaccctacgaaacggtacgtaccttaccggttagacgtacgtacgttacgttccgtggtaccttacacggtaccttacgaacgggtacaacgacgtacgtacgtaacgtcgtaacttacgcgtaacgtacgtaaacgttccggtaacgtacggaacgaccgggtaacgacggttacgagtaccgttaacgttacgtacgttaacgaaacggttaacggtaagtaccgtaaaggtacgtaaccggttactacggttagttggggttacggttcgggtacgggaacggtaaccggaacggtacgtccgtaacggttccgtacggacgtaccggaacccgtacgggtctcccggtaccccggttccgg

SEQ ID NO: 202519 - DNA, 755 bp, Homo sapiens
  misc_feature: GYAE6OF02HZLZR.21.46.E02.1.454.CMB.1.raw
  modified_base (349)..(349): a, c, t, g, unknown or other
  misc_feature (349)..(349): n is a, c, g, or t
  modified_base (627)..(627): a, c, t, g, unknown or other
  misc_feature (627)..(627): n is a, c, g, or t
tcagtcgtcgctcgcacgaccggtgctcgatttagactcatctacagggaaagggggtgggtccaggaggcagaactctgggtgtctcacatggcctggatccctctacttcctccccctcctctactctctgccacacggctctgacggtcctcctatgagctgacacacgccaccgtcggtgtcagtcgtcccaggagacgacgaccgaggactccgactcgactcgtggacgaggtaggtacggaccgtacgaaccgaaaagtaaagtacttagtaacgtttacgttacgtaacgaacgtaggaacgacgacggaccgtaacggtccccgtgttacggttaagtanaacttaagtaactaaacgactaacgtagaacgtaccgccgtcgaaagtcgtaacgccgtaggaacgtccggtttacttacccggttacgtacggtaccgtaccgtacgttacccgtacgggaacggaaccgtaacgaaccggtaccggtaaccgtttacgttaacgtacttaacgtacgtaagttaaccggacgtaagacggacggtacggacggacgtaacggtcgtaacgttaacttacgttaacgtacgtaacgaaacagtaacgtagtaacgtntaaccggttactccggtagttacggggtacgtaacgggtcggtacggaaccgtaggtacctacgggttacccgtaccggtaacggttacaaccgaccggtaccggcgttacccccggtcggtacccgg

SEQ ID NO: 202520 - DNA, 748 bp, Homo sapiens
  misc_feature: GYAE6OF02JOTGG.21.46.E02.1.454.CMB.1.raw
tcagtcgtcgctcgcacgaccggtgctcgatttagactcatctacagggaagggggtgggtccaggaggcagaactctgggtgtctcaccatggcctggatcctctacttcctcccctcctcactctctgcacaggctctgacgcctctatgagctgacacgacgcccacccgtcggtgtcagtccgtccccaggaccgaaacggcctaggactcaccgtgcctacgtggagtacttacagttacggaaccaaaagattacgttacgttggttcgttaccacgtcgaagaacgtcgacggccgtaccggcccttaggtaccgttcggtacacttaccgaagtcggacggtccacggtaccggacgtaccgtaccggtaccggggacttccccggaagggacgtaaggtactttcctccgtcgaccccttacgacggtccgtaccggaagggttaccgacggttcggcccctaccgttaggaaccttacgtaccggtacggggttccgggacccgtagggtcgtacgtacgtaggacgtcgaacgttaccttagttacggttacgtaccgacacgtagacgtagtacgtacgttacacggttagggtacgggtcgttaccgggtcgggaaggttaaccgtacgggttaccgtccgggttacgtcggaacctaaccggtccggaacggttcccgtccccggtacccgttacggtacccttcgtacccggttccgttaccccgttaccccg

SEQ ID NO: 202521 - DNA, 604 bp, Homo sapiens
  misc_feature: GYAE6OF02GTQH2.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctgcagagtggactgaccaaaagaaatatgtactttagttcggtaaccaaacgaaggaaacgccaacgggcccacgggtcccccttggtcggtttagtgtaataataataaaagacacgtaggaaggacggcccctcgaagacgactaccccgtgacggcgtattccgtcgtgggcctaccgagtctcgagggacaggctacgtctacgttgactactcgagttcgaacgtccgaggacgaagggaggacggaggctagacttattacgtagtaaccaaacgagtaagacgaagtagacggttactgtaggttgggtgttcgggacgggacggacgaaggccgtcgaccgttcgtacgtcacgaccgaggcctaccggcccgtcgg

SEQ ID NO: 202522 - DNA, 597 bp, Homo sapiens
  misc_feature: GYAE6OF02G9Q7P.21.46.E02.1.454.CMB.1.raw
  modified_base (243)..(243): a, c, t, g, unknown or other
  misc_feature (243)..(243): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacagccaccctcggtgtcagtcgtccccaggacaggacggccaggatccacctgctctgcagatggactgaccaaagaaatngtcttattggtaccaaacagaacgccaggccacggcccctgtgtagtgatataataagacactgaagacggcctanagagctaccngacgctattctctcggcctcgacgcgtacgaggtacaagtcgagtctaacgttcgtaactagttactagtagaacgtcgaggtacacggagggacgaggtcgtagtactattacgtacgtaacaaacgtagacgaataggaagttacggttactaacggtattacggggtcgttacgggagggacgggtaacgtaacggtaccgtacgggtaccttcggacgttacggacggacccgtaaggtcccgttacccggaccccgttaccgg

SEQ ID NO: 202523 - DNA, 726 bp, Homo sapiens
  misc_feature: GYAE6OF02HGA4D.21.46.E02.1.454.CMB.1.raw
  modified_base (159)..(159): a, c, t, g, unknown or other
  misc_feature (159)..(159): n is a, c, g, or t
  modified_base (243)..(243): a, c, t, g, unknown or other
  misc_feature (243)..(243): n is a, c, g, or t
  modified_base (709)..(709): a, c, t, g, unknown or other
  misc_feature (709)..(709): n is a, c, g, or t
tcagtcgtcgctcgcacgaccggtgctcgatttagactcatctacagggaaagggggtgggtccaggaggcagaactctgggtgtctcaccatgcctggatccctctacttcctcccctcctcactctctgcacaggctctgacggcctcctatgagcngacacacgcccacctcggtgtccagttcgccccaggacacgaccggaccgaggactccaccgtgtctcacgacagagtggtacncgaaccgaaaagtaaatgtacttacttagttacggtaaccaacgaagaacgaccacggtaccgacggtccccttaggtagttagtagaattaataagtaaaagacgacgttagaacggacggtacccctaagaacggacgtacctcccgtagaacgacggttaacttcggtagtccggtacctaccgacggttaccacggtaagggaccgaagtcccgttacgtaacgtaccggtttaacgtaacctaggtcttaaacgggttaacgaccgttaaccgggacgtaccgaaaggggacgtacgggacggttagacgttacgtttacgttacgttagaacctaaacggttaagaaccggagtaagttaggaaccgtttatccggtaagttacgggttcggtaccgggtagggacggtaacgaagtaccgtacgtccgtacgtaggttacggacccgaccgtacggtcnccccggttcctaccggg

SEQ ID NO: 202524 - DNA, 899 bp, Homo sapiens
  misc_feature: GYAE6OF02GNFU3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagataggactgacccaaaagaaacttatggtactttaattacggttaacccaaacgaagaacggaccgaacggacccgaacggtcccccgtgttacggtttaggttaggaattaagttaaataaaacgtaaccgaaccgttaggaacgggaaccgggtaccccttacgaacggtaacggaacccgttccccgttaacgggacggtccggttaaaccgttttcctacgtttccggggtaccctttacccggacggttaccgttaccggaacgggggaaccctaacggtaccgtaaccgggttaccgtaaccgggttttacgttaaccgttaacgtttacggtaaggttaaccgggtaaacgtttacccggaacggggtaccggaagggtaacgggaaccggggacgggttaaccggtaacgttaacccggttaaattttaaccgttacgtaaacccgtaaacgttaagggtaaaccgtacgtaaagggtttaaggtaacgggtttaaacgttacgttacgggttttaggggggtttaccgggttaccgggggtaccggggtaacgggtaaccgtaacgggtacccgttaacgggtaaccccggtttacggttaacccgggtaccgttaaccgggaaccccggttaaggtaccccggttccccggtacccccgttacccggg

SEQ ID NO: 202525 - DNA, 655 bp, Homo sapiens
  misc_feature: GYAE6OF02H73X1.21.46.E02.1.454.CMB.1.raw
  modified_base (450)..(450): a, c, t, g, unknown or other
  misc_feature (450)..(450): n is a, c, g, or t
  modified_base (544)..(544): a, c, t, g, unknown or other
  misc_feature (544)..(544): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccaccctggtgtcagtcgtaccccaggacagacggccaggactccacctgctctgacagagtggacctgaaccgaaaaagtaattagtaggtacttagttacggtaaccaaacgagaacgacccgtacggtacccgacgggtaccccgttggttacgtttaagtgtaaatttaacgtaaagttaaaacggacctaacgtaggaacggtaccggtcccccttagaaggtaccgtacctcccgagacgtcgatttccgtgtcggcctccgagttcacggaggtancgcagtctacgttcgtactagtcgacgggtcgggaccagggtgagtagtagatcaggtacttatagttcgacgacacagtacgtagtagttcgntacgtggtagggttgcggggtagacgggttaacgaggttcgtacccggttcgtacggtaccgtaccggacccgtaacggcccggtacccgtaccccgtccggtctacccgg

SEQ ID NO: 202526 - DNA, 816 bp, Homo sapiens
  misc_feature: GYAE6OF02JRGVE.21.46.E02.1.454.CMB.1.raw
  modified_base (385)..(385): a, c, t, g, unknown or other
  misc_feature (385)..(385): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctagacacagccaccctcggtgtcagtcgtcccaggacagacggccaggatccactgctctgcagagtcggactgaccaaaagaattagtgtacttacgttcggtaaccaacgagaacgccgacgggaccaccggtccccgtggttacgttagtacgtaattacgtaagtaaacgacctacgtacggaaggaccggtcccctagaacgacgtacctcccgaggtacgngtactttcgcggtacgtcctaccgacggtcctacggaacggggaacctaggtaccctacggttaccgacgggtttacgtaaccttacgtaaccggtaagggtttaacaaacgggttccgaacgggtaaccgaagggtaacgggacggtacgggttactaaggtactttaaacgtaccgttaagttaaccaaaaccggttagtaaccggtaacgtaacgggttaacgggtaacgttaaccgtttaggtaacgggttttccgggggttacggggttaaccggggaaccgggggttaacgggtaacccgaaaacgggggttacccgttacgggtaacccccgggttttaaacggtacccggacggtttaaaccccggaaccccggtaaccggggttttccccgtacccccgggtacccccggtttaaccccggg

SEQ ID NO: 202527 - DNA, 683 bp, Homo sapiens
  misc_feature: GYAE6OF02IMK7A.21.46.E02.1.454.CMB.1.raw
  modified_base (341)..(341): a, c, t, g, unknown or other
  misc_feature (341)..(341): n is a, c, g, or t
tcagtcgtcgctcgcacgaccggtgctcgatttagactcatctacagggaaagggggtgggtccaggaggcttagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgcagatggactgaccaaaagaatatgactttagttcggtaaccaacgtaagaacgccaaggcccacggccccttgtagttagtagaatataacgtaaagacacgtagagacggccctanaagagactccagacgcgtattcacgtcgcctacgagtcgtacgagggacagcgacgtctacgttcgaactatacagtacgaacgtccaggacaggaacggacgaggtctacgaacgttaacttacgtacgtaacgaaacgtaggtaacgaacgtaacgttaacggtaaggttacctagtacgggttttacgggttacgggttaccggggacggggtaaccgggtaaacccgtaaacggtccgttaccggggtaaacccccgttacgggttaaacggtaccccgaaacgggttcccccggtaacgggtacccttcccccggggtaccccccgttaacccgggg

SEQ ID NO: 202528 - DNA, 433 bp, Homo sapiens
  misc_feature: GYAE6OF02FRBOU.21.46.E02.1.454.CMB.1.raw
  modified_base (418)..(433): a, c, t, g, unknown or other
  misc_feature (418)..(433): n is a, c, g, or t
tcagtcgtcgctcgcacgaccggtgctcgatttagactcatctacagggaaggggctggtctgggtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattcctggggccagggaaccctggtaaccgtctcctcagcctccaccaaggcccatcggtcttccccctggccgcccgtgctccaggcgcacctccgagagcacagccggccctgggctcgccgtggtacaacggactacgttccgagcgacgactgagcgggctggcgaagcgcatagnnnnnnnnnnnnnnnn

SEQ ID NO: 202529 - DNA, 664 bp, Homo sapiens
  misc_feature: GYAE6OF02IFPS8.21.46.E02.1.454.CMB.1.raw
  modified_base (211)..(211): a, c, t, g, unknown or other
  misc_feature (211)..(211): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccgaggacagaccggccgaggancacctgctctgcagagtggactgaccaaaagaatatgtactttagttacggtaaccaacgaagaacgccgacggaccacggccccgtagtacgttagtcgtaataattaataaacgtactacgtggaacggaccggtaccccttagaacggtaagtaccgttaccccgaggtaccgacgttacttcctcgtcggccttccgagtcgtacggacgggacacggactacggtacgtacgttanacctntacgtagtagacgtcgaggngaggacggacggacgngttacaagttacttacgataaacaagtaacgtaagactaagggtaagtacgtaacttagttaggttgggttacgggtcgggacgggaacggtacgtaacggcgttacggtaccccgttacggtacggttaccgacgtaccccggacggtcccggtcccgtaccccggtccg

SEQ ID NO: 202530 - DNA, 699 bp, Homo sapiens
  misc_feature: GYAE6OF02HAQHP.21.46.E02.1.454.CMB.1.raw
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgcctctgcagatggactgaccaaaagaaatntgactttattacggtaaccaacgaagaacgccgaggaccccgacggtccccctgttagttacgtgtaataataactaaagacacgtagaaggacggccctacgaagagactcccctaggacgtcgaactttcctacgttcggacccttaccgacgccttacggaacgggaacacgacgtacgtacccgtaagtttcgaacttacgtagtacggtagaacggttcgaacgtacgaaggacgggacgaggtatacggtacttaataccgtacgtaactaaacgagtaacggacgtaagggttacgtacggttacttacggtagtttacggggttcggttacccggggagggtaacgggaaccgtaacgggttaccgtaccggtaccgtacccgtttaaggtacccgttaccgggacccgtaaccgggtccttccccggtcccccggtttaaccggg

SEQ ID NO: 202531 - DNA, 722 bp, Homo sapiens
  misc_feature: GYAE6OF02GMOQL.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgttcggtgtcagtcgtccccgaggacaggacggccaggactcacctgctctgcagatcggactcgaccaaaaggtaaatatgtactttagttcggtaaccaacgagaacgccgaggccgacggcccctgtgttagtgactataataaagacacgtaggagacggccctacgagacgtactcccgtagagtacgtattctcgtcggcttccgaacgtcgtccgaaaggggacctacgccgtacggtacctacggttacgaacgttaacgtcgtaaggtacgtaaacgtaccgaagggacgtaagggaacgggtacgggacggtacgtacggttaaccttaatttaccgtacgttaacaaaacgtaaggtaacgtaacgtaagggtaaggttaacggttaccttaaggttaggttcggggtttacggtcccgggtacggggtaacccggaaccggtaacgttaccggtaccgggtaacccgttacccgggtaggttacccgaccggtaccccggtaaacgggtccttaccccggggcccccgtttacccgg

SEQ ID NO: 202532 - DNA, 688 bp, Homo sapiens
  misc_feature: GYAE6OF02FRA1T.21.46.E02.1.454.CMB.1.raw
  modified_base (219)..(219): a, c, t, g, unknown or other
  misc_feature (219)..(219): n is a, c, g, or t
  modified_base (262)..(262): a, c, t, g, unknown or other
  misc_feature (262)..(262): n is a, c, g, or t
  modified_base (290)..(290): a, c, t, g, unknown or other
  misc_feature (290)..(290): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtcccccaggacagacggccaggatcacctgctcngcagatggactgaccaaaagaaatatgctttatggtaaccaanagaagccaggccaggcccctgtgttagngatataataaaagacactgagacggccctacgaagagactcccgtagacgacgtattaccttcgtgggtccctaccgtacgccgttacgaacggggaacctaacggcctaacggttaccaacgggtttagtaaccgtttaacgtacgtaaggttacggtaaacggttacccgaagggtaccgaagggaacgggacggaagggtaccgtagtaactttaacgttacgttacgttaaaccaaaagtaacggtaacgtaacgtaagggtaacgtaaggttactacgtaacggtttgggtacgtttcgggacgggtaacgggaccgaaggtcgtacggtaccgttaccggttacggtacgtacgacccgaacggtaccctacccggtaccccccgttacggg

SEQ ID NO: 202533 - DNA, 674 bp, Homo sapiens
  misc_feature: GYAE6OF02IFV8Y.21.46.E02.1.454.CMB.1.raw
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (444)..(444): a, c, t, g, unknown or other
  misc_feature (444)..(444): n is a, c, g, or t
  modified_base (593)..(593): a, c, t, g, unknown or other
  misc_feature (593)..(593): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacaggctctgaggtcctcctatgagctgacacacgccctacccgtggtgtcagtccgtaccccaggacacggaccgccaggctccaccttgctctgacagtntaggacctgaaccaaaanaatntagtactttagtaccggtacaacgagacgcgacggaccgacggtccctggttagttagtacgtaattaacgtaagtaaacgtacgtacgttaggaacgtccggaccctcgaaggtaccgtaaccgttcccgtagtacggtacttacgtttcctcggtcggtacctccgaacgtcctacggacggtacncgtacgtacgtacgtcgttactaactgtacgagttagaccgtgaacggtacagggtaacgggacgacggttctaagtacttaagttacgactaacgaagtacggtaacacggtaagtagtaaccgttactaggttaggtcggttacggngggtacggacggtactaccggtacgttccggaccgttacggcgtaccgaccgtaccggacgttcccgccgtacccgttccg

SEQ ID NO: 202534 - DNA, 838 bp, Homo sapiens
  misc_feature: GYAE6OF02H6D8E.21.46.E02.1.454.CMB.1.raw
tcagtcgtcgctcgcacgaccggtgctcgatttagactcatctacagggaaagggggtgggtccaggaggcagaactctggggtgtctcaccatggcctggatccctctacttctcccctctcactctctgcacaggctctgacggccttctatgagtctagaccacacgcccacccgtcggtgtccagtccgtccccgaggacacggaccggccgaaggacttccaccgtgccttcgtacggccagtacttcgggactacggaacctaaaagtaaacttgtacggtacctttagttacggtaacctaacgaaggaacgaccgaccggaccgtacggtccccgttggtacggttacgtaagtattaactaaagtaaacggaaccacgtacggaacggaccggtacccctagaacgaacgtacctaccccgtaggtacggtaccggtaacttccgttacggtacgtaccgtaccgtacggtaccgtaaccgggtacggaactacgggtacgtaccggttaccgttaccgggtttaacgaactttacgtaacggtaaggttacggaaacggttaccggaagtacggaaacgggtacgggaacggtaacgttacggtaacgtaacgtttaacgttaaccgacggtaaaccgaaacgtttaacggaacggtaacgtaacggtaacgggtaacgttacgtacggtttagggttacggggttacgggtacgggaccggggttaacggaaccggaacgggttcggtaaccggtacccggttaagtaacgggtcctaaccgggtacccggtacggtacccggttaccccggtacccgggttaaccg

SEQ ID NO: 202535 - DNA, 696 bp, Homo sapiens
  misc_feature: GYAE6OF02JQSQ6.21.46.E02.1.454.CMB.1.raw
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (409)..(409): a, c, t, g, unknown or other
  misc_feature (409)..(409): n is a, c, g, or t
tcagtcgtcgctcgcacgaccggtgctcgatttagactcatctacagggaaaggggtaggggtccgaggaggcagaactctgggtgtctcaccatggcctggatcctctacttctcccctcctcactctctgcacaggctctgaggcctcctatgagctgacacagcccaccctggtgtcagttcgaccccaggacngaccggcaggatcacgtnctntgcagagtggactgaccaaagatatgtacttattacggtaccaagacgaacgcacggccacggcccctagtgttaggttagacttataagtaaaacgacacgtaggtaaggaccggtaccctcgaaggtaactaccgttaccccgtaggacgaaccggttactttcgtaccggtagtccttaaccggtacnccgtacggtaacgggaccgtaggacctaacgttaccaacggtttcgactacttacgacgtacggtacgttacgacggtacgaacggtacggaaccggtacggtacgtcggtaacttagtttacctaacgtaccgtaaaaccgaggttaacgacgtaaggtaacggtaacgtacgtacttaggttcgggtacggttacggtacgggacggtacgtaacggtcgttacggtaaccggtcgtaacggtccgaacggtacccgtaaggtcccgtaccggtacccccgtcgg

SEQ ID NO: 202536 - DNA, 516 bp, Homo sapiens
  misc_feature: GYAE6OF02HCVKW.21.46.E02.1.454.CMB.1.raw
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaagaaatatgcttattggtaccaacagaagccaggccaggcccctgtgttagtgatatataaagacactgagaggccctnagagatccccgtagagcgattctctggcctccagctcgagggacagcagtcacgttgattctcagtcggggcccaggtggaggatgagctgactactactgttactcagcagacagctagtgtcatcgaggggctagttcggcgggacgggtaccgtgggtacgaccggttcgtaggtcgacgcccgaggcgtccgtccccgg

SEQ ID NO: 202537 - DNA, 676 bp, Homo sapiens
  misc_feature: GYAE6OF02I8CJ2.21.46.E02.1.454.CMB.1.raw
  modified_base (136)..(136): a, c, t, g, unknown or other
  misc_feature (136)..(136): n is a, c, g, or t
  modified_base (141)..(141): a, c, t, g, unknown or other
  misc_feature (141)..(141): n is a, c, g, or t
  modified_base (163)..(163): a, c, t, g, unknown or other
  misc_feature (163)..(163): n is a, c, g, or t
  modified_base (179)..(179): a, c, t, g, unknown or other
  misc_feature (179)..(179): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
  modified_base (494)..(494): a, c, t, g, unknown or other
  misc_feature (494)..(494): n is a, c, g, or t
  modified_base (513)..(513): a, c, t, g, unknown or other
  misc_feature (513)..(513): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacnggctntgagcctctatgagctgacacngacctacccgtcggtntcagttcgcccaggacagcggcaggtactcactgctctgcagatggactagaacctaaaagtaatagtcgtctttagttacgtaaaccaacaacgaacgcccgacggccgaccggtacccttggtgttaagtaggtattaactaataaacggacaacggtcgaggccgggtccctanaaggacgtactccccgtagacgtntaccgttctcgtcgtacctccgacgtctacggaacggctacggacgtaggtacgtacggtactacgttcgtacggtaagtaaggtaccgtacgtaggacgtaggaacggtacgngttacgtacgttaacgttntaccgttagaactaagagtacctagtagtaagggtcttaacgtcgttaggttcgggttacgtccggggtacggtacggaaccggttcgccgggttaccgtaccggttacggaccggttacggaccgacgggtcccgtacccgtaccccggtacccgttcccgg

SEQ ID NO: 202538 - DNA, 718 bp, Homo sapiens
  misc_feature: GYAE6OF02HDM3P.21.46.E02.1.454.CMB.1.raw
  modified_base (241)..(241): a, c, t, g, unknown or other
  misc_feature (241)..(241): n is a, c, g, or t
  modified_base (262)..(262): a, c, t, g, unknown or other
  misc_feature (262)..(262): n is a, c, g, or t
  modified_base (293)..(293): a, c, t, g, unknown or other
  misc_feature (293)..(293): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatntgtacttattaggtaaccaanagaacgccaggccacggtcccctgtgttagngatataataagacacgtagagacggccctagaagagtactcccgtaggacgctaacgtttcctacgtcggcctccgacgcgtcgaacgggacacggccgtaacgtccgtacgttacgacttacgtacgtaggttacgtaacggtccgaggaacggtaggaacgggacggacgggtaccgtaagttacgttaactttaaccgtacgtaaaccgtaaacgtacgggtaaacgtaacgtaagggttaaacggtaaccggtttaacttccggttaagggtttacgggggtttaccggttacgggggaccggggttaacgggacccggtaaacggtcccggttaaccggtacccgttaccggttaacgggttacccgaacccggtaccccggaacgggtcccccggtacccggtccccccggttaaccgg

SEQ ID NO: 202539 - DNA, 635 bp, Homo sapiens
  misc_feature: GYAE6OF02H7N4D.21.46.E02.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagaccggccaggactcacctgctctgcangtggactgacaaagaaatntgtacttagttcggtaaccaacgaagaacgccgaggccacggcccctgttcgttagtcgaattaataagtaaagacacgtagagacggccctacgagacgtactcctggagtccgtacttcgtcgtcgctaccgagctacggacggtacacgcgagtccgtacgttcgtactacgtactagtagtacgtacgagtacgaggacggaacggacgacgttagacttactttacctagaacctaaagtaacggtaagtacgaaggttagacggttaccttaggtaggttggggttagtaccggtaggggaccggtaacgcgtaccggtccggtaacccggttcgtacggttacgacggtcccgtaacggccgtaccccggtcccgttacccgg

SEQ ID NO: 202540 - DNA, 739 bp, Homo sapiens
  misc_feature: GYAE6OF02HQ58X.21.46.E02.1.454.CMB.1.raw
  modified_base (550)..(550): a, c, t, g, unknown or other
  misc_feature (550)..(550): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacggccttcctatgagctgacacacgcccaccctcggtgtcagtcgtccccgaggacaggaccggccaaggactccgacctgcctcgtcggcagagtcggactacgaaccaaaagtaaattatagtacttagtttacggaacctaaacaaggaagaccgagggacccaacggtccccctggttacggtttaggtacgtataagttaaacttaaaaacggaacctaacgttaggaacggtacccgggcccttacgaaacgtaagaccttaccccgttaggaacgtacgttaactttcgtcgttcgggcctcgaacggtctacggagggtaacacggcagtccgtacggttagtactacgtcgtaacggtagaacgtacgagggactaagggaacggacggaggtacncgtaaacttaacgttcgagtaaccaaagacgtaagaacctagggtaagtaacggtccttaacggaggttttcggggtacgttccggggacgggtacgggtaaccgaacgggtaccgtaccgggtacccgtttacggacggtaccgtacggcccggtaaaggtaccccggttccgacccccgtttccggg

SEQ ID NO: 202541 - DNA, 809 bp, Homo sapiens
  misc_feature: GYAE6OF02IOPQY.21.46.E02.1.454.CMB.1.raw
  modified_base (577)..(577): a, c, t, g, unknown or other
  misc_feature (577)..(577): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacccttcggtgtcagtcgtccccaggacagaccggccaggatcacctgctcgtgcagagtggactgaccaaagaaatatgtactttattcggtaacccaaacgaacggaacgacccgaagggccccgaaccggtcccccgttaggttacggtttagttaggaacttaattaaaagttaaaacggaacctaacgtacgggaacggtaaccgggaccccgttacgaacggacggtaaccttcccccgttggaaacggcgttaacgttttaccgtccgtttcgggtcccttaccgacgtacccgttaccgaagggaactacggaccgtacgttaccgttaacgttcggtaaccttacgtacgtaaggtacggaaacggttcccgaagggtacgaaagggaccggtaacgggnggtaccttagtacttttacgttaacgttacgaaccgtaaataaacggtaacgtaacgtagtaacggtaacgttaaccgttcgaggttttacggggttaccgggttcgggtacggacggggtaaaccgaacgggttaccggtacggtaacccgggtttaccgttaacgggtacccttaacccggacccgggtaaaccggtcccggttaccccccgggtccccgttaacccggg

SEQ ID NO: 202542 - DNA, 746 bp, Homo sapiens
  misc_feature: GYAE6OF02JA97I.21.46.E02.1.454.CMB.1.raw
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtagggtccgaggaggcagaactctgggtgtctcaccatggcctggatcctctacttctcccctcctcactctctgcacaggctctgaggcctcctatgagctgacacagccaccctcggtgtacagtcgtccccaggacagacggtccaggatcgacctgctctgcagatggacctgaccaaagaaatntgcttatggtaccaacagaagccaggccaggcccctgtcgttagtgatagtataaagacacgtagacgtacggacccgtacaagtacgactccccgttaggaacgtaccgtaactttccgtcgttacgggtccttcccgaacggtcgtaccgaaggggaacctacgggacgtacggttacctaacggtttagaaccgtttaacgtctaacgggttaacggtaaaccgttaccccgaagggaacccgtaaggaacgggtaacccggtaggaccgtttacggtaacttaacgtttactaccgttaacgaaaaccgtaggtaaaccggtacgtaaagggtaagtaacggttaacgttaccgtaaggtttagggggtacgttaaccggggcggggtaaagggtcccggtaaacggttacccgtacgggtaaccccggttaccgtttaagggaccttaccgggaaccccgtaagggttaccccgtccggttaccccccgttacgg

SEQ ID NO: 202543 - DNA, 651 bp, Homo sapiens
  misc_feature: GYAE6OF02F0SUZ.21.46.E02.1.454.CMB.1.raw
  modified_base (245)..(245): a, c, t, g, unknown or other
  misc_feature (245)..(245): n is a, c, g, or t
  modified_base (323)..(323): a, c, t, g, unknown or other
  misc_feature (323)..(323): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatggactgaccaaaagaaatntgtcttattggtaccaacagaacgccaggccacggcccctgtgttacgtgatatataaagacactagagacgccctanagagtactcccgtagagcgtattctctggcctcgagtctacgagggacagcgtacgtacgtacgttcgactactcgagtagtaacgtcgaggtcgaaggacggacggtaggctagtacttacgttacgtacgtacaaacgtagtaacgacgtaaaggtaggtaacggttaactacgttaaggtttcggggttacggttaccggggacgggtaacgggtaaccggtaacgggtaccggttaaccggtaacccggttaccggtaacgggttaccgaaccgggttaccccggaacgggttcccggtacccggtccccccggttaacccggg

SEQ ID NO: 202544 - DNA, 707 bp, Homo sapiens
  misc_feature: GYAE6OF02I35G9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatccacctgctctgcagatcggactagaccaaaagaaatatgtactttagttcggtaaccaacagaacgccgaaggccacggccccttgtgttagtgatataataaacgactacgtaggacgtaccggccctagagacgtactcccgtagacgaccgttatttacccgtcgtacggtccctaccgtacggtccttacggaacggggtaaccaagccgttaacgttacccggtacgttgtaaccttaacgtacgaaggttacggaacgttacccggagggtacgaacgggaacgggacggacggtacgtacgtaacttaacgttacgtacgtaaccgaaagtacggtaacgaacgtaggtacgtaacggttaccttaggttacggtttcgggtagtttacccgggacgggtaaccgggacgtaacggtaccgtaccggtaccgtaccgtttaggaccgtaccggtacccgaacggttcccgtacccggtcccccgtacgg

SEQ ID NO: 202545 - DNA, 761 bp, Homo sapiens
  misc_feature: GYAE6OF02GMY83.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatntgcttatggtaccacagagcagccgagccctgtgtagtgatatataaagacactgacgacggccctcgagagactcccgtagagcgtattctcgtaggcctccaggcctacggaacggggtacaacggtcctaggtaccgtacggtttacgaaccttaagtccgtaaggtacgtaaacggttcccgtaagggacccgtaacgggaacgggtaacccgggtagggtacgtacggtaaacgtttaacgtttaaccgtttacggttaacctaaaaaccgaagggtttaaccgtaaccgggtaaacgggtttaacggggtaaaccgggtttaaccgttacggttaaacgggttttacgggggtttacgggtttacccgggggacgggggttaaacgggggaaccctaaaaggggtccccggtttaaacgggtaccccggttaccgggtttaacgggttaccgtaacccgggtaccccgggaacgggtaccccgttaccccggtacccccccgtttaaccgggg

SEQ ID NO: 202546 - DNA, 670 bp, Homo sapiens
  misc_feature: GYAE6OF02FW8J7.21.46.E02.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacctcggtgtcagtcgtcccaggacagaccggccaggatccactgctcngcagatggactgaccaaagaatatgacttattaggtaccaaacagaagaccgacggccaggtcccctgtcgttagtgaatataataaaacgacaacgtagagacggccctacgagaaggtactacccctaggaacgacgtaacttcgtcttcgggacctacgacgcgtacgaacgggacgacgtacgacgttcgtaacgttcgtaacttaacgtacgtaacgtaacggtaacgtaccgaacgggacgaaacgggaacgggaccggtaagggtctaacggtaactttaacgtttaacgtacgtaaaccgaaactaaggtaacgtaaccgtaagtaaggtacggttaactacgtaggtttacgggttaggtccggtacgggacggaacccgtaaggccgtacggtaccgtaccgtagttacgacgaccgtaacggtcgtaccgtccccgtacgg

SEQ ID NO: 202547 - DNA, 660 bp, Homo sapiens
  misc_feature: GYAE6OF02F92DF.21.46.E02.1.454.CMB.1.raw
  modified_base (106)..(106): a, c, t, g, unknown or other
  misc_feature (106)..(106): n is a, c, g, or t
  modified_base (248)..(248): a, c, t, g, unknown or other
  misc_feature (248)..(248): n is a, c, g, or t
  modified_base (585)..(585): a, c, t, g, unknown or other
  misc_feature (585)..(585): n is a, c, g, or t
tcagtcgtcgctcgcacgaccggtgctcgatttagactcatctacagggaaaggggtgggtccaggaggcagaactctgggtgtctcaccatggcctggatccctntacttctccccctctcactctctgcacaggctctgaggcctcctatgagctgacacagcccaccctggtgtcaggttcgtccccaggacagacggccaggactcacctgcctctgcagatggactggaccaaaagtaaattntcggtactttagttggtaaccaacagaacgccaggccacggcccctagttacgttagtgtatataataaagactaacttggacgacgggaccctcgaagacgtacttccgttagacgtcggtaactttccgtccgtgggtccttacccgagtaccttcgaacggggactacggacgtaagtccgtaacggtttcggaacttacgtactaaggtacgtaacggttaccgacggacgaaggtaacgggacgtacggtacgtagtaacgttacgttacgtactaacgaaaccgtagtacgaacgtagtaaggacgtaactcgtagttgggtcgttacggngggttaacggaccgtaaggccgttacgtaccgtcgtaggtcacggacccgaaggtccctacccggcccttaccgg

SEQ ID NO: 202548 - DNA, 962 bp, Homo sapiens
  misc_feature: GYAE6OF02JE07G.21.46.E02.1.454.CMB.1.raw
  modified_base (268)..(268): a, c, t, g, unknown or other
  misc_feature (268)..(268): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgcagatggactgaccaaaaggtaaatatgtctttaagttacggtaaccaanaggaacgcccgagggccacgggcccccttggttaggtttaacggtggtaacttaataacgttaaaacggacctaacgttggaacggaccgggacccccttacgaaggtaacggtaaccttccccgttaggacggtaccggtaactttccgtacgttcgggccctaccgtaggcccttacggaagggggtaaccaacggtcgtaacggttccgtaacggtttcgtaaaccgtttaacgttaccgtaacgggttacgggtaaaacgttacccgggaaacgggggaccttaaacgggggaacccgggggaaccggggtaaacggggttaacccgtttaaacgggttaacccgtttaaaaccggtttttaaccgttaaccggggttaaaacccgttaaaaacccggtaaggggtttaaacgtaaaccccgggtaaaggggtttaaaaccgggttaccgggtttaaaccgttaccggtttaaaacgggggtttttcgggggggttaccgggtttttaacccggggggtaaccggggggaaaccggggttacccggtaaaaacgggggttcccgttaaccgggggtaaaacccccgggtttccggttaaccgggggtacccgttaacccggggaaccccccgggttaaacggggttcccccggtttaacccccgggtcccccccggttttaaccccgggg

SEQ ID NO: 202549 - DNA, 746 bp, Homo sapiens
  misc_feature: GYAE6OF02JKBA9.21.46.E02.1.454.CMB.1.raw
  modified_base (323)..(323): a, c, t, g, unknown or other
  misc_feature (323)..(323): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgcctctgcagatggactgaccaaagaaatatgcttattacggtaccaacagaacgcacggccgacggcccctgtgttagtagatatataaagacacgtgagacggccctanaagagactcccgtaggagcgtacttcgcgttaggcctccaacggtcctacgaacgggggaaccacggtacctaacgggttcctaaccggttttacggaactttaacgtaccgtaaagttacggggtaaaccgtcccgtaaacgggggactaaaccggggaaaggggtaaacccgggaacgggtacctacggtaaacccgttactttaaccggtacgttaaccgaaaacgtaaggttaacgaacgtaacggttaaaggtaacgggtttacctacgtaaggttttagggggttacggttccggggacggggtacgggtaacccgtaacgggtaccgttaccgggtaacccggttaccggtacgggttaccgtaacgggaccccgtaacggggtccttaccccgggttcccccccggttaaccggg

SEQ ID NO: 202550 - DNA, 594 bp, Homo sapiens
  misc_feature: GYAE6OF02IUHCX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatatgtcttattggtaaccaacagaacgccaggccacggcccctgtgttagtgatatataaagacacgtagagacggccctagagagactcccgtaggacgacgtattcgtactcggcctccagccgtacgaacgggtacagccgtagtccgacgttagactaatcgaagtagtaacgtccgaggacgaacggtaggacgtaggtcgtagaccgttaattacgtacgtaacaagagtagaacgtaagtagtaagtactagtaggttgggtcgttcgggacggtaggaccgtaagtcgtacgaccggttaccgtaaggtccgaacgacccgaacgggacctccgtccccgtacgg

SEQ ID NO: 202551 - DNA, 666 bp, Homo sapiens
  misc_feature: GYAE6OF02HWK0U.21.46.E02.1.454.CMB.1.raw
  modified_base (324)..(324): a, c, t, g, unknown or other
  misc_feature (324)..(324): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctgacacagccaccctggtgtcagtcgtccccaggacagacggccaggactcacctgctctgcagatggactgacaaaagaatagtgacttattacggtaaccaaacagacgcacggccacggcccctgtgttagtgaattaataataaagacactgagacggccctanacgagtactcccgagacgcgtaatttccgtcgtcggtcctaccgacgtcgttacggaacgggtacacggactacggttaccgtacggttacgtaaccgtacgtacgtaacggttacggtaaacgttacccggaaggtacggaacgggtaaacgggaacggtaacggtacgttacgaaaccgtttaacgttaacgtacgtaaactaaaggtacgtaaagaacgtaggtaacggtaacgttaccgtacgttacggtttgggtacggtttcggagggaacggacgaagtcgtacggtacccgttcgtaggtcgacggaccgtacggcgtcccggcccgttaccgg

SEQ ID NO: 202552 - DNA, 813 bp, Homo sapiens
  misc_feature: GYAE6OF02HGHKT.21.46.E02.1.454.CMB.1.raw
tcagtcgtcgctcgcacgaccggtgctcgatttagactcatctacaggggaaaggggggtgggtccaggaggcagaactctggggtgtctcaccatggcctggatccctctacttcctccccctcctcactctctgcacgaggctctggacggcccttcctatggacgctgacacacgcccacccgtcggtgtcaggtcgtaccccgaggaccacggaccggaccgaggaactcctaccgtggccttcgtcgaccgtaagagtacggtacctacggaacccgtaaaaaggtaattagtcgttaacgttttaacgtacgggttaaaccaaacgaacggaaaccggacccgaacgggaccccgtacccgggtccccgtttaggttaacggttaacggtagtaacgttaaaataaacggttaaaaccgaacgtaccgtagggaacggtacccgggtaccctaacgaacggtaacgtaccgtcccgtagacggtaccgtacttccgtcgtacgtccgtaccgacgtcgtacgtacgggactacgacgtacgtacgtacggtactactagtacggtaagtaccgacggtacgacggacggtaaggacggacgacggtacgtaccggtaattaacgttacgtacgaaacctaaacggttacggtaacgtaggtaaacgttaaggggtccttaaccgtaacggttggttaaccgggggttcgggttaacgggaccgggaaggtacccggttaaggcgtaccggttaccgacggttacggccgtaacggacccgtaggtacccgtccccgtacccgtacgg

SEQ ID NO: 202553 - DNA, 545 bp, Homo sapiens
  misc_feature: GYAE6OF02JGLEV.21.46.E02.1.454.CMB.1.raw
  modified_base (467)..(467): a, c, t, g, unknown or other
  misc_feature (467)..(467): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctgcagatcggactgaccaaagaaacttatgtctttattggtaacccaaacagaagccaaggccaggcccctgtcgttagtgatataataaagacactgagacggcctcagagactccctgagcgtattctcgtcgctccagcctcgagggacagcgagtcacgttgactatcaggtacgaagtccgaggacaaggacggtacgaggctagacttatactgtaccaaagacgtagacagtagacgttanctaagttggtcgttcggacgggagacgtaaggcgtcggtaccgtcgtagtcgacgaccgaggtcgtccgcccgtaccg

SEQ ID NO: 202554 - DNA, 727 bp, Homo sapiens
  misc_feature: GYAE6OF02HOD04.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatccactgctctcggcagacgtggactcgaaccaaaagtaaatgtcgtacttagttcggtaaccaaacgagaaacgccacggccacggtcccctgtgttacgtagatataataaacgacaacgtgacgacggccacagacgtaccgtcctaggcggacttacgttcgtctcggacctcgtacgacgttccggaaggaccacggacctacggtactacggttacgtaactcgtacgtaaggtagtacggacgaaggacgaaggtacgggaacggtcgaacgtttcgaacttacgttaacgttcgaaaccgtaaacgtaacggtaaggtaaccgtaacgggttaaacggaacggtttaaccgtaacgggtaacggtttacggggttccgggtttaccggggaccggggtaaacgggtacccggtaaacggttacccgtacgggttaaccccggttaccgttaacggggaaccctacccggaaccggtaccgtacggttaccccccggttccccggtaaaccggg

SEQ ID NO: 202555 - DNA, 723 bp, Homo sapiens
  misc_feature: GYAE6OF02IVSJZ.21.46.E02.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacccttggtgtcagtcgtccccaggacagaccggccaggactccgactgctntgcagactggactgacaaagaatatgtacgttacttggtaaccaacgtagaacgccgaggccacggtcccctgtcgttagtcgatactaataagacactaggacgtacggcctacacggtagtacgtcccagcgactacgtttacgtccgtcggtacctccgtagtccgtacgaacgggtactacggtacgtacggttacgtaaccgttagtaaccttacgtaccggaaaggttacgaaacgttacccggaaggtaccgaacgggtaacgggaccggtaaggtaccgtaaccgttaacttaaagtttaccgtacgtaaacctaaacggtaaggttaaccgaaggtaagtttaacgtaggttaccttaagtaagggtttcgggttacgggttaccgggacggggtaaaccgaccggtaacgtcccgttaaggaccccgttacggtacgggaacccttacgggaacccctacgggtaccgtaccccggttccccgttaacccggg

SEQ ID NO: 202556 - DNA, 671 bp, Homo sapiens
  misc_feature: GYAE6OF02GDLH9.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacggccaggactcacctgctctgcagatggactgaccaaaagaaactatacgtcttagttacggtaaccaacgagaacgaccgaggaccacggccctggtcgttagtgtaatagtaataaagacacgtagacggacgtccctagaacgacgtactccgagacgacgtacttcgtcgtcgccttaccgacgtcgtacgacggtacacgacgtacgtcgtacgttacgacttaactacgtagtacgaacgtcgaaggtacgaaggtacggacggtaggtactacggtaacttagttacgtacgtaacgaaacgtacgtaagtacgtaacgtagaacggttacgtacgttagggtttacgggttcgggtacgggtacgggaacgggtaaccggtaacggtaccgttaccggaacccggttcggtaacggtaccggaccggtacccgaacggtcccgtacccggtccccgttaaccgg

SEQ ID NO: 202557 - DNA, 1019 bp, Homo sapiens
  misc_feature: GYAE6OF02F7DUI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccacccgtcggtgtcagtgtccccaggacagacggccaggatcacctgctctgcagagtggactgaccaaaagtaaaatagtgtactttaatttacgggtaaccctaaaacaaggaaacgaccgaacggaccccgtaacgggaccccccttaggttacggtttaagtacggtaaattaaacgttaaagtaaaaacggtaacctaacgttacggaacggtaaacgggtcccccttaacgaaacggtaacggtaacttaccccccgttaggaacggtaccggttaaacgttttcccgttaccggttacgggtacccgtttaccccgtaaacggtcccgtttaccggaaacgggggtaaacccgaaccggtaaccgtaaccgggtttaacccgtaaccgggttttaaccggtaaacccgtttaaacgtttacccgtaaaacgggtttaacggtaaaaccgggtttaccccggaaaggggtaacccggtaaacggggaaaaccggggaaaccgggtaacgggggttaaccgtaccgggttaaaaccgttttaaacctttaaacgggtttaaccgggttaaacccgtaaaaaccggttaaaacgggttaaaccggtaaacggttaaaaccggggtaaacgggttaaaccgggttaaaccgttaaccgttaaagggttttacgggggttaacgggtttacccggggacggggggtaaaccgggtaaacccggtaaaacgggttcccggttaaccgggtaacccccggtttacggtaaaccgggttacccggaaacgggtaaccccccggtaaacggggtacccccggttaccggttaccccccccggtttaacccgggg

SEQ ID NO: 202558 - DNA, 756 bp, Homo sapiens
  misc_feature: GYAE6OF02IPL4P.21.46.E02.1.454.CMB.1.raw
  modified_base (262)..(262): a, c, t, g, unknown or other
  misc_feature (262)..(262): n is a, c, g, or t
tcagtcgtcgctcgcacgaccggtgctcgatttagactcatctacagggaaagggggtgggtccaggaggcagaactctgggtgtctcaccatggcctggactccctctacttctccccctcctcactctctgcacaggctctgacggcctcctagtgagctgacacacgcccacccgtcggtgtccagtcgtccccaggacacggaccggccgaggactcctaccgtgtctcgtgcagtgtggactcgaacaaagaatgtntacttagttacgtaaccaacacgaacgaccgacggaccgtacggccccgtaggttacgttagtagtaagtaacgttaaacgtaaaacggtacctaacgtcggaacggtaccggtacccgtacgaacggacgtaccgtcccgtaggaacgtcggtactttcgtcgtcgtccgtaccgtagtaccgtacggacggacacgtacgtacgtaccgtaacgttacgtaactacgtaacgtaggttaacggaaccgtcgtaacgggacgtaacgggaacggtacgggtacggtacgtacgtaacgttaccgttacgtacgtaaaccgtaacgtaagtacggaacgtaaggtaacgtaacggttacgtacgttacggttaggggttaccgttggggaaccgggtacggaccgtaaacggtccgaacgggtacccggttaccgtacggtaccggtacccggtaccggtacccggtcccgttaccccgggtacccgtacccgg

SEQ ID NO: 202559 - DNA, 803 bp, Homo sapiens
  misc_feature: GYAE6OF02JXBYV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtcgtcagtcgtccccgaggaccgagaccggccgaggatccaccgtgcctacgtgccagagtaggacgtcgaaccaaaagtaattactagtactttacttacggtaaccaacgaaggaaccgaccgacgggacccgaccggtcccccgttggttacggttacggagtagtaaacgttaagtaaaacgtaccgaagtacggaacggtaccgggaccctacggaacggaagttaaccgtccccgagtacgtcccggtaactttccgtcgttcggccctacccgggtacgtacccgttaacggaaccggggtaccgtaacggtcccggttaacggttacccgtttacgggttaacggtaaccgtttacccgtaacggtttaagggtaaccgtaacggttaacggaccgggacggtaacgggaacgggtaaccggagggtaccgttagtaaccgttagttaaccgttacgtaacggaaactaaggtacgtaaacgacgtacggtacggttacttacggttaggtacgggttagtacgggtacggtacggtaccggtaaccggtacggtaccggtaccggttacgtaccggtcgaccggacccgtgacccgttacccgcccccgttacgg

SEQ ID NO: 202560 - DNA, 868 bp, Homo sapiens
  misc_feature: GYAE6OF02I2H7W.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacacgcccacccgtcggtgtccagtcgtccccaggacaggccggaccgacggaacttgacccttgccgtctaggactaggacttgggaccctaaggaaccctaaagaaagtacttagtaccgttaaccttaggtaaccaaacgacgaaaggccccaagggtcccctaggtcccccttaggtgttaagttagtaattaaagtaacgtaaaacgtacgaactagggaccttacggacccgtaacgtaacgtaccgagtaccccgtggtaacgttcgtactttccggtacctaccggtacctcccgtacgacggtaacacgggtaccgaacgggtcctacgttaccggtaacccgttaagtactaccggttctaaaggttaccgaacggtaccggaacggtacggaaccggtaagggtaacccgacggttaacgttaaccgtttaacgttaacgttacgttaaacccgtaaaggaaacggttaacggaaacggttaagttaccgggttaacggtaaacggtttaaccgttagggttaacgggttaccggggttacgggtaccggggtaacccgggtaacgggacccggttaaagggttacccggtaacccggtaaccggtttacccgggaacgggttaacccccgaaccggggtaaccccgttacccgggtaccccccgggttaccccgttacccggttaccccccgg

SEQ ID NO: 202561 - DNA, 655 bp, Homo sapiens
  misc_feature: GYAE6OF02IK56E.21.46.E02.1.454.CMB.1.raw
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaaagaaatatgtacttattaggtaaccaaacaagaagccaggccacggcccctgtacgtagtgactataataaagacacgtggaagacgccctanaagagtactccngacgcgacttcncgtggcctcgagtcgtacgaagggtacagacgtagtacgtacgttacgacgttacgtacgaggtacgaaacgttccgaacgggacaaggaagggacggaaggtcttaacgaacttaatttacgtacgtaacgaaaacgtaggtaagaaacctaggtaacggtaacggttaactaccgttaaggtttcgggggttcgtaccggggacggtaacggggaaccctaaggtccgtacggtacccggttaccgtaacgggtaccaaccggacccggaacggtcccgttccggacccccgttaccgg

SEQ ID NO: 202562 - DNA, 712 bp, Homo sapiens
  misc_feature: GYAE6OF02GWQ1Z.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacggcctcctatgagctagacacacgcccaccctcggtgtcaggtccgtaccccgaggacacggaccggccaggactccacctgctctgcagagtcggactcgaaccaaaagtaaatagtcgtactttagttacggtaaccaagaacggaacgccgacggaccgaccggccccgttggttaggttagtacgtaattaataagtaaacgactacgtaggacgacggtccctacgagagtacgtcccgtagacgtacgtactttcgtcgtcggtacctaccgacgtcgtacggacggacgacgacgtaggtacctacggttacacgttagtacgtaaggtaggtaaccggtacgagggacgtaacgggacgggtacggaggtccgtaaggttacttaacgttaacgtacgtaacaaacgtagtaacgtaacgtaggttaggtacgttactacggttaggttaggggttacgggtacgggacgggtaacggtacgtacgggtaccgtacggtaccggttaccgtagggtaccgaccggtaccggacggtcccgtccccggcccgttaccgg

SEQ ID NO: 202563 - DNA, 860 bp, Homo sapiens
  misc_feature: GYAE6OF02HHM5M.21.46.E02.1.454.CMB.1.raw
tcagtcgtcgctcgcacgaccggtgctcgatttagactcatctacaggggaaagggggtgggtccacggaggcagaactctgggtgtcttcaccatggcctggatccctctacttctcccctcctcactctctgcactaggctctgaggtcctcctatgagtcgtggacacagccaccctcggtgtcagtcgtccccgaggacagacgggccgagggactccaccgtgcgtcgtcgcagatcggactcgaccaaaagaaagtagtcgtactttattacggtaccaaacaacggaaacgtacccgaaggaccgaacggtccccgtggttacggtttacggttggtactaacgttaaagtaaaacgactaacggtaggaacgggtacggtacccctacggaaggtacgtaaccgtacccgttaggtacggtcggtaatttaccgtactgggtaccttaccgacgtaccgttaccggaacggggaacacggtaccgtaacggttaccgtaaccggtttagtaaaccgtacgttacgtaacggttaacggaaacgttacccgaaagggaccgttaaagggaacgggaaaccgggttacggttaaccgttaacggttaccgtttaaacgttaacgtttacggtaaacctaaaacggtaaacggtaaacggtaaaccgtaaagggttaacgggtaaccggttaaaccgttccgttaaagggtttccgggtttacggggttaccgggttacgggtaaacgggtacccggtaaagtcccggtaacggtaacccgggttaaccgttacgggttaccgacgggtaacccgtaacgggtaccggttacccgggtacccccgttaacccggg

SEQ ID NO: 202564 - DNA, 671 bp, Homo sapiens
  misc_feature: GYAE6OF02IXGYY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacacgcccacccgtcggtgtcagttcgtccccaggacaggaccggccaggactccacctgcctctgcagatggacctcgaccaaaagaatatgtactttattcggtaaccaaacgaagaacgccgaggcccacggccccctgtgttacgtgtaatataagtaaagacacgtagaggacggccctacgaagacgacttaccgtagacgacgtactttccgtcgtcggtacctccgagtccgtacgacgggacacgcgtacgtccgtacgttcgacttacgtacgtaggtagtaacgtaccgaggcaagggacggacggaggcgttagtacttagttacgtctaacgaacgtaagtaagacgtaaggtagtaacggtacttacgtagggtttcgggttcggttaccgggacgggaacgggaccgtaacggtccgtaccgggtaacccgttaccggttaacggtaccaccggtacccggaacggtcccgtacccggtcccccgttaccggg

SEQ ID NO: 202565 - DNA, 878 bp, Homo sapiens
  misc_feature: GYAE6OF02H5W85.21.46.E02.1.454.CMB.1.raw
tcagtcgtcgctcgcacgaccggtgctcgatttagactcatctacagggaaaggggggtgggtccaggaggcagaactctgggtgtctcaccatggcctggatccctctacttctccccctcctcactctctcgcacaggctctgaggcctcctagtcgagctggaccacagccaccctggtgtcagttcgtccccgaggacaggaccggccaggactccaacctgcctctcggcaaggtgtacgggactcggaccaaaaggtaatatgtacttagttaggtaaccaaactaggaacgaccgaacggacccgaacgggtaccccctggttacggttaagtaccgaattaactaaagttaaaaacggtacaacgtaggtaacgacggtccccttagaacggtacgtaccgttaccccgtacgggtaacgtaccggttaacttttcccgttacgtttccggggacccttaacccggtaaacggttcccgttaacgggtaacggggggaaaccctacgggtacccgtaaacggtttcccgtaaaccgggtttttacggaacctttaaccggtttaccggaacgggttttaacggaaacggtttaccccggaaggggaaccgtaagggggtaacgggaaccggtaggggttaccctttacgggtaaacctttaacgtttacctcgggtaaaccaaacgtaacgggttaacgaacgtacggttaacgggtaggttaccgttaggacggtttaggggttcggttaccgggtacgggtaacgggtacccgtaaaggtaccgtttacccgggaaccgtttacccggtaacggtcccgtacgggtaaccccgtaacggtcccgttaccccgtccccggttaaccggg

SEQ ID NO: 202566 - DNA, 735 bp, Homo sapiens
  misc_feature: GYAE6OF02IOPH0.21.46.E02.1.454.CMB.1.raw
  modified_base (178)..(178): a, c, t, g, unknown or other
  misc_feature (178)..(178): n is a, c, g, or t
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatccacctgcctctgcagagtcggactgaccaaaagaatntgacttagttggtaaccaacagaacgccaggccaggcccctagtgttagtagatagtaataaagacacgtagagacggtccctagaggagacttcccgtagacgcgtaatttccgtacgtcgggacctaccgacggtccttaccggaaacgggggaccaacggtacctaacggttaccgttaaccgggtttacgaaccgtttaacgtaccggtaaacgggttacggtaaaccgggttaccccgtaaaggggaccgtaaaggggaaaccgggaaccggaacgggttaccgtacggttaaacctttacgtttaacctacggtaaccaaacgtaggtaacgaacggtaagtacggtaacgttaccttagtaaaggtttcggggtacggtttccgggagggtaaccgggaaccgtaaggtccgttacggtacccggttacggttaacggtccgacgccccggaaagggtccctaccccgggccccttaccggg

SEQ ID NO: 202567 - DNA, 802 bp, Homo sapiens
  misc_feature: GYAE6OF02H02OJ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacgccaggactcacctgctctgcagatggactgaaccaaaagaattatgtacttagttacggtaaccaaacgagaacgacccgacggacccgtaccggcccccttggttagtttacggtaggtaattaagtaaacgtaaaacgtacgtaaccgtaggaacggtaccgggtcccctacgaacggaagtacctccccggtaggacgtaccgttactttccgtccgttcggtaccgttacccgaacggtcctaacgggaacgggaaccgtacgaccgtacggtccgttacggttacgtaacttacgtacgtaaaggtacggtaacgtaccggtaacgggacgaagggtaccggaaggacgggtacgttagtaaccgtttaaccttaaacgtcgtaaaccgtaaacgtaacggtaacgtaacggtaacgttaaacggtaacggttaaccgtacggtttaggtttacggggttaagggttacccggggaagggaccgggtaaccggaaccggttccggtaacggttaccccggttaaccgggttaacgggtaccgtaccgggaaccccggtaacgggttacccgttacccccgggcccccgtttaccgg

SEQ ID NO: 202568 - DNA, 758 bp, Homo sapiens
  misc_feature: GYAE6OF02HWVU7.21.46.E02.1.454.CMB.1.raw
  modified_base (135)..(135): a, c, t, g, unknown or other
  misc_feature (135)..(135): n is a, c, g, or t
  modified_base (328)..(328): a, c, t, g, unknown or other
  misc_feature (328)..(328): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcanaggctctgaggcctcctatgagctgacacagccacccttcggtgtcagtcgtccccaggacagacggccaggactccacctgctctgcagatggactcgaccaaaagtaaatatacgtacttaagttacggtaacccaaagaagaacggccaggccgacggtacccctgttacggttagtagtacttaataanaaaagtacaacgtagacgacggccctagaagcgtacctccgtagacgcgtacgttaccgtgtcggcctaccagtctacggaacgggaccagtaccgtagttaccgtacggttacgtaacttagtaccgtagttaacgtaaacgttccggaaggtacgaacgggacgggtaacggaacggtcgtttaagaactttaaccgtttaacgtaccggtaaaccgttaaacgtaaagttaacgggtaaaacgttagggtaaagggtacggtttaaccttacggttaagggtttccggggtttacgggttccgggtacgggggaaccgggtaccggaaacgggtccgtttacggggacccctttaacccggttaggttaacccgaaccgggtacccggtaaacgggttccccgtcccggttacccccggttacccgg

SEQ ID NO: 202569 - DNA, 675 bp, Homo sapiens
  misc_feature: GYAE6OF02I4UKA.21.46.E02.1.454.CMB.1.raw
  modified_base (156)..(156): a, c, t, g, unknown or other
  misc_feature (156)..(156): n is a, c, g, or t
  modified_base (231)..(231): a, c, t, g, unknown or other
  misc_feature (231)..(231): n is a, c, g, or t
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctccatganctgacacacgcccacccttcggtgtcagtcgtacccccaaggaccacggacggccaggactccaccgtgctcgtnacgagagtcggactcggaacctaaaaagaaactgtntaccgttaatacggtaaccaacgacgaacgccgacggaccaccggaccccgtgtagtagtntaagtaactaagtaaaacgactacgtaggagtaccggccctacgagaacgtcctacccgtagacgtacgtattaccgtcgttcgaccgtacacgcgtacggacggacacgactacgtacctaggtacacttaagtcgaagtactacggtacagggtacaacggacgacgaggttcacgtacgttaactacgtacaacgaaacgagtaacgacgaagtaacgtacgtaccttaacgtacggtttgggtacgtacgggacggtaacggaaccgaacgttacggccgttaaccggaccgttaggacccttaacggacccgtaacggtccgtacccgtcccgttaacccgg

SEQ ID NO: 202570 - DNA, 788 bp, Homo sapiens
  misc_feature: GYAE6OF02IZJ4M.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtggtgtcagtcgtccccgaggacaggaccggccaggactccacctgcctcgtgcagagtggactgaaccaaagaactatgtactttagttacggtaaccaacgaagaacgccgacggacccgaacggtcccccttaggttacggtttaggttagtaatttaagttaaacgttaaaacggaaccgtaacgttacggaaacgggtaacccgggtccccttaaccgaaggtaacgtaccgttaccccgtaggacgtaccggtaacctttccgtaccgtccggtacccttaccgacggtaccgtacggacgggtaacacgtaccgtagtaccgtacggtttagaaccttagtaccgtaaggttacggtaccgttaccggaaggaccgtaagggaaggaccggtaggtaccgtaggtaacctttaacgttaacgttacgtaaacccgtaaagtaacggtaaacgaaccgtaaggtaggttaacgggtaccttaaggtagggtttacgggttacggttaccggggacgggtaacggtaaccgaaggtccgtaacggtacccgttacggtacgtaccgaccggtaacccgtacggtaccccttcccggcccccgttaccgg

SEQ ID NO: 202571 - DNA, 705 bp, Homo sapiens
  misc_feature: GYAE6OF02FNAUJ.21.46.E02.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacacgcccacctcggtntcagtcgtccccaggacagacggccaggactccactgctctgacagatggactgaccaaagaaatatgtacttagttacggtaaccaagaagtaacgaccgaacggacccgaaccggccccgttaggttacggttaggtagtaacttaataaacgtaaaagtaacctacgtaggacggtaccggtccctacgaggtaacgtcttaccccgtaggacgtaccgtatttacctcgtcggtacctacccgagtccgtacggaacgggtaacgacgcgtacgtccgtagttaccgattactacggtagtacggtaaccgtacggacgggacgaaggtacgggacgtagggacttacgtaacttacgttacgtcggtaaacaacgtacgtaaagacgtaaggtagtacgttaacgtagtaggtttcgggcgggttacgggacgggaaccggtacgaaggtccgtaggtaacccgttacggttcggaccgtacgacccggtaacgtcccggttacccggccccgttaaccg

SEQ ID NO: 202572 - DNA, 817 bp, Homo sapiens
  misc_feature: GYAE6OF02I32PC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacagcccacccgtcggtgtcagtcgtccccaggacaaacggccagactcacctgctcgtggagtattcattgaccaaaagatatacttggttcgtccagtcaagaagtcacggccaacggccccctagtactcggtcacttccagtcggaacggccaggtaccggaccgacgtacccggtccgggtactaccccggtggaagacggtactttcgtaccttccggaccccttccgaacggtcccttaccgggacggggtaacgtacggtccgggtacccctaacttcggaacttaccggtacgtacggggtacccggggaccccgttagggggtaccggaaccgtggttaacggtaacgtcgtacgtaacctttaacggttacgtttacgttacccggctaacccggaagtaccgtaacgggttacggtcggttacgttacggttaacggggaacgggggttttacggtaccgggggtaacgggtaacccggggtaaccgtttaaacggggttccttacccggttaccggggttttaccggtacggtaacccggtacccgggtaacggttccccgtttacccccgggttacccccggttaccgggttaccccctgtttacccccgggtttccccgtttacccccccggttccccc

SEQ ID NO: 202573 - DNA, 548 bp, Homo sapiens
  misc_feature: GYAE6OF02JE0N2.21.46.E02.1.454.CMB.1.raw
  modified_base (342)..(342): a, c, t, g, unknown or other
  misc_feature (342)..(342): n is a, c, g, or t
  modified_base (366)..(366): a, c, t, g, unknown or other
  misc_feature (366)..(366): n is a, c, g, or t
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaaagaaatatgacttattcggtaccaaacaggaagaccacggccaggcccctgtgttagtgatatataaagacatgagacggccctgagatactccgtgagcgattcncgtcggctccagctacgacggganagtcagtcgtacgttgactatcgagtagacgtccgaagcgaaggtacggacgtgctacgaacttattactgtaacaacgaganactaagagtacgttacncgtagttgggtgttcggacgggaggacctaaggcgtagtaccgttcgtaggtcaccggacacggtcgtcccgacccgttcgg

SEQ ID NO: 202574 - DNA, 845 bp, Homo sapiens
  misc_feature: GYAE6OF02GJNS5.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacacgacggccaggactcacctgctctgacagagtcggactcgaaccaaaagtaattatcgtactttagtacggtaacccaaagtacgaacgccgaacggccgacggtccccgttaggtgttaaggtcaattaagtaacgttaaaacgacctaacgtggaacgaccggtacccctaagaaaagtccttacccgtaggaacgtcgttaactttccgcttacgggtcccttaccgaacgtccgtacggaaacgggacacgtacgacgttacgtaccggttttgaacttacgtaacgacgtacggaacgtacggtacgggacgaagggacggacgggacggttctaacggtaacttttaaactttccggtaacgttaaacctaaaaccgtaagggtaaccgtaaacggttaaacgggtacgttaaaccggggtttaacttaccggtttaagggtttacgggggtttaccggtacccggggggtaaacggggtaccgggtaaacggtaaccgggtttacccggtaacccggggtttaacccccgttacccgggggtttaaacggttaccccggaaaacccgttttaaccccggggtaccgggtaaccccccggttttaccccgggttcccccccggggttaacccgtttaaccccg

SEQ ID NO: 202575 - DNA, 627 bp, Homo sapiens
  misc_feature: GYAE6OF02HC4FH.21.46.E02.1.454.CMB.1.raw
  modified_base (319)..(319): a, c, t, g, unknown or other
  misc_feature (319)..(319): n is a, c, g, or t
  modified_base (470)..(470): a, c, t, g, unknown or other
  misc_feature (470)..(470): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaaagaaatatgcttattggtaccaacagaagccaggccacggcccctgtgttagtgaatatataaagacactgagacggccctanagacgactccctagacgcgtattctcgtggcctaccgacgtcctacgagggtaacacgactacggttccacggtttgaacttagtaccgaggtacggtaacgtccgaggtacgaaggaacgggacggaaggtcgtacgtacttatttacgnggtaaccaacgaagttaacgacgtaagtagtacggtaacttctacggttagggttcgttacggggacggtacgggaccgtaaggtccgtacggtacccgttaccggtaacgtccgaaccggtaccggaacggccttacccggacccccgttaccggg

SEQ ID NO: 202576 - DNA, 685 bp, Homo sapiens
  misc_feature: GYAE6OF02FJIEB.21.46.E02.1.454.CMB.1.raw
  modified_base (312)..(312): a, c, t, g, unknown or other
  misc_feature (312)..(312): n is a, c, g, or t
  modified_base (412)..(412): a, c, t, g, unknown or other
  misc_feature (412)..(412): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtaccccaggacagacggcaggatcacctgcctctgcagagtggactgaccaaagtaattatgtacttatacggtaaccaacagaacgccgaggccacggtcccctaggtagttacgtgtatagtaanaaacgtacctaacgtagagtacggccctagaagtacgacttcccgtaggacgccgtacttcgtcgtcggtcctaccgtagtccgttcggaacgggtaacncgtaccgtaacgtacgtaaccggtttacgtaacttaacgtacgtaacgtacggtaaacgtacccggtaggaacgtaagggaaccgggtaaggtacggacttaacgggtacttaacgttactaggtaaaccaaggtaacgtaacgtaaggtagtaacggtacgttaacgtacgttacggttgggtacgggttccggacgggacggaccgtaagcgtacgtaacccggtgtaacggtcgacggtacccgaaggtcccgtaccggtcccgttaccg

SEQ ID NO: 202577 - DNA, 813 bp, Homo sapiens
  misc_feature: GYAE6OF02GL4N0.21.46.E02.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtntcagtcgtccccgaggacagaccggccaggactccacctgcttctgcaagtagtcgggactgaccgaaaagtaaatagtcgtactttaagttacggtaaccaacgtaagaacgaccgaggccaccggtccccgtaggttacgttagtagtaattaataaagtaaaacgacctaacgtaggaacggacggtaccctacgaaggaacgtacgtacccctagggacgtaccggttactttacctcggttcggtaccttacccggacggttcctacggaaacggggtaaccgaaacggaccgtacggttaaccgtacggtttacgtaaaccgttaaggttaccgtaagggttaacggtaaacgttacccggaaaggggactaaaggggaaacgggaccggaacggtacgtacgtaaacgttaacgtttaacgtacgtaaccgtaaaacgtacggtaacgaaaggtacgtaacggtaacggttaactcggttacgtttaggggtacggttaccggggacgggtaacggtaacccggtaacggttaccgtaccgggtaaccccggtttaaccggttaaggacccgtacgggtaaccccgtaaccggtaccgttaccccgggtcccccgtttaacccggg

SEQ ID NO: 202578 - DNA, 813 bp, Homo sapiens
  misc_feature: GYAE6OF02JJLEL.21.46.E02.1.454.CMB.1.raw
  modified_base (252)..(252): a, c, t, g, unknown or other
  misc_feature (252)..(252): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacagccaccctggtgtcagtcgtccccaggacagaccggccaggactcaccgtgctctgcagatcggactcggaacccaaaagtaaacgtntcggtacctttaagttacgggtaaacccaaaacgaacggtaaacgacccgaacgggtacccctaacgggtccccccgttggtttacggttaacggtttacggaaacgtttaaactaaacgttaaaaacgggtaccctaaacgttacggaaacggaaccccgggttaacccgtaccgaaggttaacggtaaccttcccccggttaagggacggtaccggttacgtttacccgttcgtaccggggacccttaccggaaccgtacccggttagggaaaccggaacgtacgtaccggtaaccgttacgtaaccgtttacggtaaccttacttacgtaacgaacggttactaaccggaggacgaacgggtaacggacgtacggtacgtacgtaacgttaacgttacgtacgtaaccaaagtacgtaacgaagtaaggttaagtacggtaaccttacgttaaggttccggttaggtaccggggtacgtacggaccgtaacggtcgtaaccggtccgttaccgtaggtaccgaaccggaccgtaagtcccggtccgtacccccgtcgg

SEQ ID NO: 202579 - DNA, 786 bp, Homo sapiens
  misc_feature: GYAE6OF02GWZWF.21.46.E02.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgccacgaggctctggacggcctcctatgagctgacacagcccaccgtcggtgtcagtcgtcccaggacagacgcaggactcaccgtnactctagctagatggactcgaacaaaagtaatgtcgtactttaagttacggaacccaagtaggaaacgccaacgggccaacgggtccccttaggtagtttacgtgaaattacgtaaaagtaaaacgcgttaacacgggtaaagccggtaccctagaaggtaacgcctacccgtagacggttacgtactttcgtcgtcggtacctaccgtaagcccgttaaggaacggaccgaaacgttcgtaaaccggtttacgaacggttttaacccggaactttaacgtccgttaaacgggttaacggaaaccgtttacccggaaaggtacccgtaaaggggtaacggaacccggtagggtcccttaaagggttaaccttaacggttttaacggctttaaacggaaaaccgtttcggaaacgtacggaaaggtttaacgggaagtttaacctaggttaggttaacggggttcggaccgggtagggaaccgaacggtaacggtaccgtaacgggtccgttaaacgtcggtaacgaccgtaacccggtaaggtcccgttacccggacccgttaccggg

SEQ ID NO: 202580 - DNA, 777 bp, Homo sapiens
  misc_feature: GYAE6OF02I9NI6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatatgtacttattggtaaccaacgagaagccacggccgacggacccctgtcgttagtgatatataaagacacgtgaagaggccctacgagagactcccgtgacgcgtattaccgtcttgggccttaccgacgctacgtaaggggaccagtacacgttccgtaacggtttgtaaccgtaacgttaccgaaagggttcggaaacggtttacccgaaagggaccggaaacgggaaacgggttaaccgggaacgggtacgttaacggtaccgtttaaacgttaaccgttacggtaaccgtaaaaacggacgttaaacgtaacgtaaacgggtttaagtaacgggtttaacccttaagttaacggttttacgggggtttaggttacccggggacggggtaaccggggtaacccgtaaacggggttaaccgttacccggggttaacccggtttacccggttaaccgggttaaccgtaacccggggtaacccccgtaaacgggttaccccgttacccgggttccccccccggtttaaacccgggg

SEQ ID NO: 202581 - DNA, 614 bp, Homo sapiens
  misc_feature: GYAE6OF02FK0WC.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatntgacttattggtaccaacagaagccaggccacggcccctgtgttagtgtatataataaacgacactggacgacggccccgagacgactcctgacgcgtattctcgtcggctaccagctcgacgggacacgcgacgtcgtacgttcgactatacgagtacggaacgtccgtaaggcgaacggacggtaacgaggcttagacttaattacgtactacaaactaagtacgaagtacggtaagtacggtacgtacgtaggttcgggttggttcgggacgggtacgggaaccgtaggacgtccggaaccggttaccgtacgggtaccgtaacggacccgtaacggtaccgtcccggttcccccggtacgttaccccg

SEQ ID NO: 202582 - DNA, 778 bp, Homo sapiens
  misc_feature: GYAE6OF02GC2N4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtgtcgagtcgtaccccaggacacggacggcaggatccacctgctctgcagagtcggactgaaccaaaagaaactatacggtactttagttacggtaaccaaacgaaggaaacgccgaacggaccccgaaccgggtcccccttggttacggtttaaggtagtaagttaattaaagtaaaacgtacctaacgtagggaacggaccgggtacccctacgaaggtaacgtaccttaccccgtaggaacggtaccgttaactttccgttccgtacggtccttaccgacgtccgtacggacgggtacgacgtcgtaacgttccgtaagttcgaacttacgtacgtaggtacggtaacgtaccgacggacgaagggacgggaacggaacggtcgttagtaacttacgttacgttacgtaacgaaaacgtacgtaacgtacgtaacggtaggtaacgttaaccgttagttacggtttggggtacgggttacgggacggggtaacggaaccggttaacggaccgggttaccggtaacccggttaccggttaacggtaccggaaccggtacccggaccgggtcccgtacccggtccccccgttaccggg

SEQ ID NO: 202583 - DNA, 793 bp, Homo sapiens
  misc_feature: GYAE6OF02HCJSO.21.46.E02.1.454.CMB.1.raw
  modified_base (218)..(218): a, c, t, g, unknown or other
  misc_feature (218)..(218): n is a, c, g, or t
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacagccacccgtcggtgtcagtcgtccccaggacagaccggccaggactcacctnctctgcagatggactgaccaaagaaatntgtactttattcggtaacaacagaacgtccgaggtaccgacggaccccttggttgttacggtatacgtaataactaaaagaccaacgtggaagtaccggccccttagaacgtaacgtaccgtaccctagggtaaccggtccgttaacgtttccgtaccgtttacgggtaccttaccccgaggtcccgttaacgggaacgggtaacctaaacggggaccttaccgggtaaccgttaacggttttaccgaaccttacgttaaccggtaaggttaccggtaaccgttaccggtaacggaccgtaaagggaaccggtaacgggaggtacgttacgttaaccgttagttaaccgttacggtaaactaaacggtaggttaacgtaaggtacggtaacggttaagttaccttaggttaacggttaggggttccgggttacggggtaccggggtaacggtaccgggaacggttccggtaaccgttaacccggtacggttaaccgggtaccaccgggtaaccccgagggtccccgttaccgaccccccggttccgg

SEQ ID NO: 202584 - DNA, 913 bp, Homo sapiens
  misc_feature: GYAE6OF02HYEBI.21.46.E02.1.454.CMB.1.raw
  modified_base (133)..(133): a, c, t, g, unknown or other
  misc_feature (133)..(133): n is a, c, g, or t
  modified_base (168)..(168): a, c, t, g, unknown or other
  misc_feature (168)..(168): n is a, c, g, or t
tcagtcgtcgctcgcacgaccggtgctcgatttagactcatctacagggaaagggggtgggtccgaggaggcgagaactctgggtgtctcaccatggcctggatccctctacttctcccctcctcactctctncacaggctctgacggcctccgtatgagctgacacncgccctaccctggtgtcagtcgtccctaggacaggaccggccaaggactcacctgctctacgcgagagtacgggactacgaaccgaaaagtaattacgtcggttacttaagtttacggtaacccaaacgaacgaaacgccgaacggacccgacggtacccccgtagttacggtttacggtacgtagtaaattaaacgtaaacgtaacgtaccgtaggtacgaacggtccccgtacgaacggtaacgacctaccgtacgacgtacggtactttcgttacgtcggtctaccgtacgtctaccggaggaacgtacgacgtacgtacgtacggttacgacgttacgtacggtaacgtcggtaaacgtcggtaacgggaacgaagggaaccgggtaaacggtacgggtacccgttaacggtaactttaaaccggttaacgttacggtaaaaccccgttaaaacggtaaacgggttaaaacgaaacccgggtaaacggtttaaacgggaacgggtttaaacccttacgggtttaaacggtttacggggggtttaccgtttaccgggggaccgggggttaaacccgggttaaccggaaaccgggttaaccccgggtttaaccggggtaaccccgttttaacccccgggggttaaaggggtaacccccgttaaccccggggggtaaccccgttaaaacccgggggttccccgggtttaaccccccggggtccccccggttttaacccccgggg

SEQ ID NO: 202585 - DNA, 799 bp, Homo sapiens
  misc_feature: GYAE6OF02GW6CX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccctcctatgagctgacacagccctacccgtggtgtcagtcgtccccgaggacaggacggccaggatcacctgcctctgacagagtgactgaccaaaagaatgtagactttagttacggtaaccaacgacgaacgaccgaggacccctacggtcccccgtggttacggttaggtacgtaacgttagttaaacgtaaaacgtaacgtaccgttagggtaacggaccggtaccccgtacgtaaggaacggtaccttcccgtacggtacggtccggttaactttccgtccggttacggtcctaccgacgtaccgtcggaacgggaccacggacgtaacgttaccgtaacggttcgtaacgttacgtcgtacggtaacgtacggtaccgagggtaccggaagggacgggtacggacgggtacttcgtaaacgttacgttacgtacgtaaccgaagtaaggtaacgtaacgtaaggttaacgtaacgggttacttaggtacggtttacgggggttacgggttaccgggtaccgggggtaaggtaacccggtaacgggtccgttacccgggtaacccggttacccggttaaggttcccggaacccggttaacccgggtacgggtacccccgttcccgggtaccccccgtttaacccggg

SEQ ID NO: 202586 - DNA, 806 bp, Homo sapiens
  misc_feature: GYAE6OF02H2THW.21.46.E02.1.454.CMB.1.raw
  modified_base (183)..(183): a, c, t, g, unknown or other
  misc_feature (183)..(183): n is a, c, g, or t
  modified_base (190)..(190): a, c, t, g, unknown or other
  misc_feature (190)..(190): n is a, c, g, or t
  modified_base (259)..(259): a, c, t, g, unknown or other
  misc_feature (259)..(259): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacgaggctctgacggccttcctatgagctagacacagaccacccgtggtntcagtcncccgagacaggacgccgagactcactcgctctgacagtagtcgggactcgaacctaaaagtaaacttancgttactttaagttacggtaaaccaaacgaacggaaccggaccgaacggacccgaccggtacccccgttagggtttagtttaacggagttaacgttaattaaaacgttaaaacgaccaacgtcggaacggaccggtaccctaaggaacgaacggtaaccgttccccgaaggaacgtacgttaccgtttctccggttacgaccgttccgaagccgttacggaacgggtacaggacgtacgtacgttaaccgtagtaaccgttaagtaccgtaggtaaccgtaacggttaccgacgggacgaacgggagtaacgcggtactacggtaactttagttaaccgttagaaccttaaaacgaacgtaagtaacggtacggtaaggtacggtaacttgggtaaacggttacggggttacgggtacgggtacccggggaacgggtaacccgaagttacccgggtacggtaaacccgggttttcccgaaggtaccccggtaccgggaaacccctacggggttacccgtcccccgggttaccccgtttaaccccggg

SEQ ID NO: 202587 - DNA, 738 bp, Homo sapiens
  misc_feature: GYAE6OF02HQHZQ.21.46.E02.1.454.CMB.1.raw
  modified_base (134)..(134): a, c, t, g, unknown or other
  misc_feature (134)..(134): n is a, c, g, or t
  modified_base (646)..(646): a, c, t, g, unknown or other
  misc_feature (646)..(646): n is a, c, g, or t
tcagtcgtcgctcgcacgaccggtgctcgatttagactcatctacaggggaaagggggtgggtccaggaggcagaactcgtgggtgtctcaccatggcctggactccctctacttcctcccctcctcactctcngcacaggctctggacggtcctactatgagctgacacgcgcccacccgtggtagtcaggttcgaccccgaggacacggaccgggaccagggactaccaccgtgccttcgtcggactaggagtcgggtaactaacggaacctaaaaagtaattcgtgtacgttttaacgttaccggtaaccaaagtaggacggaccgaacggccgtaccggtccctagggttagttacgtaggtaacttaagtaaacgtaaacgacacgtaggacgacggtaccctgaacgcgtactaccgagacgtcgtaccttcgtacgtcggtcctacgacgtcgtacgggacggagtacggacctggtaccttacgggtacacgttaagcgtaaggtcgaacgttaccggagtaccgagggaacgacgacgggtactaggtaacttagtaacgtacgaaactaacggtagtaacgtacgtagtaaggtacggtacttacggtagggttacgggtcggtacggggaaccgngggtaacccgtaaggtccggttaccggaccggttaccggttaaggcctaaccgggtaccgtaaccggggcccttaccccgggtccggtaccg

SEQ ID NO: 202588 - DNA, 749 bp, Homo sapiens
  misc_feature: GYAE6OF02J3KVS.21.46.E02.1.454.CMB.1.raw
  modified_base (159)..(159): a, c, t, g, unknown or other
  misc_feature (159)..(159): n is a, c, g, or t
  modified_base (653)..(653): a, c, t, g, unknown or other
  misc_feature (653)..(653): n is a, c, g, or t
tcagtcgtcgctcgcacgaccggtgctcgatttagactcatctacagggaaagggggtggtccaggaggcagaactctgggtgtctcaccatggcctggactccctctacttccgtcccctctcactctctgccacacggctcgtgacggtcctctagngacgtctacgaccactccgccctacccgttcggtacgtccgacgtccgtaccccgaggtaccacggaccggccgaaggtacctccgacccgttcgtaccgttcgtacggaccgtacggtacgttacggacctaacgtaaaaccgtaaagtacttcgtacgttacgttacgtacgaacacgacgacgaccgaccggccgtacgtaccgttgttaggtactagtaactaacgttaacaacgacgtacgtacgaacggtaccgacctaggtaacgtaccgtaccttacggtacgtacggttcctacgttccgtacgtccgtacggtaaccacggttacgacggaacggtacgtaccgacgtaccgttactacgttacgacgttccgaggtacggtaacgaaccggtcgtaccggaacggacggttaaccggacgttacgtcgtaagttacctactacgacgaacgtaagtcgaacgtagtacgtacgtagttaccgnggttaggccgggtacggcgtacgaagtaccggccgttacgaccgttacgaccgacgtaccgaccggtacccgtccgaccggttcccctcggtaccc

SEQ ID NO: 202589 - DNA, 673 bp, Homo sapiens
  misc_feature: GYAE6OF02JWRKH.21.46.E02.1.454.CMB.1.raw
  modified_base (238)..(238): a, c, t, g, unknown or other
  misc_feature (238)..(238): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgccacaggctctgaggccctcctatgagctgacacagcccacccgtcggtgtcaggtcgtcccccaggacacggtaccggccgaggatccaccctgctcctagcagntggactgaccaaagaaatatcggtcttattcggtaccaacagaacgcacggcacggccctagtgttagtgtatatagtaaanacacgtgacgacgtccnagagactcctgagtccgagttctccgtgtcctacgactcgtacgaggtacacgacgacgtacgtacgttacggacttacgtacgtagttacggaacggtaccgaggacgtaggacggacggacggtctaggtaccttaagttaccgttagtaaccgtaagaacgtacggtaacgaagttaacgggtaggttacctaggttaggtttacgggttacgggtccgggacggggttacggaaccggtacgttacccggtacggtaacccggttaccggtaccggttaccggaacccggttacccggacggtaccgtaccccggtacccccggttacccgg

SEQ ID NO: 202590 - DNA, 714 bp, Homo sapiens
  misc_feature: GYAE6OF02I56G0.21.46.E02.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtntcagtgtccccaggacagacggccaggatcaccgtgctctgcagatggactgaccaaaagaactatgtactttagttacggtaaccaacagtaacgccaggccgacggtccccctggttcgtttagtagaattactaagtaaagactaacgtggaaggtacggtcccctagaacgacgtaccttcccgtggagaccgtaatttccgtactcgggtccctaccgtacgtcctacggaacgggaccgtaacggccgtaaggtaccgtacggtttacgaacgttactaccgtaaggtacgtaacggtccggtaagggccgaaaggggacggtacggagggtacctaggtaaccttacgttactcgtaaacaaacggttagttaaccgaacgtaaggttaacggtacggttaaccttagtacggtttagggttcggttaccgggacgggtacggtaaccggaagttccgtagggtaacccggtcgttacggtaccgtccgtaacccgggacggtcccggtacccggtcccccggtaccgg

SEQ ID NO: 202591 - DNA, 725 bp, Homo sapiens
  misc_feature: GYAE6OF02HR5U0.21.46.E02.1.454.CMB.1.raw
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
  modified_base (459)..(459): a, c, t, g, unknown or other
  misc_feature (459)..(459): n is a, c, g, or t
tcagtcgtcgctcgcacgaccggtgctcgatttagactcatctacagggaaagggggtgggtccgaggaggcgagaactctgggtgtctcaccatggcctggactccctctacttcctcccctcctcactctctgcacaggctctgaggcctcctatgacgctagacacagcccaccctcggtgtcagtcgtccccaggacacggacggccaggactccaccgtgctctgctagntgggacctgaccaaaagtaaatntggtacttattacggtaaccaaacgaagaacgaccgacgaccgacggaccccttggtagttacgtagaactaataacgtaaagacacgttgagacggtacctacgaagacgtactaccgtagaaggtccgtaacgttcgtcgttacggctaccgagtctacggacggtacgacgcgacgtcgtaacgttacgacgttaacncgtaacggtagtaacggcaaacgggtcggaaggacgggaacgacgggtacgttagtaaccgttattaacgtcggtaaacctaaggtaaacggttaacgaaccgttaagggtaactaacggggttactcgggtaaacgttttgggggaccgggtttacggacgggggtaaccggtaaccggaacggtaccgtacgggtaaccccggttacgtacggttaccgaacggttacccggaagggtttaccctcccgggaccccgttacggg

SEQ ID NO: 202592 - DNA, 801 bp, Homo sapiens
  misc_feature: GYAE6OF02HYMPM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcgggtgtcagtcgtccccgaggacaggaccggccaggactccacctgctctgcagatggactcgaccaaaagaatagtgtactttagttacggtaaccaaacagaagccaggccacggccctgtgttagtgatataacgtaaacgacacgtgaacggacggtccctcgaaggacgtaccgtccccgtaggacgccgttactttccgtcgtccggcctaccgtacgtccgtacggaggggaaccaacggtcgacggttaccgtacggtttacgaaccgttacgtaccgtaacgggttacggtaacccggtccgaaacggggtaccgaaagggaaccgggaacggtaacgggttaccgtaacggttaaaccgtttaacgttaaacccgttaggttaaacccgaaaaacggttaggttaaacggaaccgttaaggggtttaaacgaaccgggtttactttaacggtttaacgggtttacgggggtttccgggttacgggggtaccggggaacgggtaaccccgtaaagggttcccggtaacggggttaaccccttacccgggtaaccgggttcccgaaccggtacccccggttaacggtcccggtttccccgtaccccccggtttaccgg

SEQ ID NO: 202593 - DNA, 662 bp, Homo sapiens
  misc_feature: GYAE6OF02JO3YG.21.46.E02.1.454.CMB.1.raw
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
tcagtcgtcgctcgcacgaccggtgctcgatttagactcatctacagggaaagggggtaggggtccgaggaggcagaactctgggtgtctcaccatggcctggatccctctacttctcccctcctcactctctgcacaggctctgaggcctcctatgagcctgacacagcccacccgtcggtgtcagtcgtccccaggacagacggccaggatccacctgctctgcagatggactggaccaaagaaatntgtacttatcggtaaccaanagaacgcacggccacggcccttgtcgtaagtcatatataaacggacacgtagacgacggtcctagagtaacgactccgtgaagtccgtacttactcgtacggcctacctaaggcccgttagaacggggaaccacgcgtaacgttacgacgttacgacttaatcgaagtgaacggtaccgagacgtaggaacggaccggtaggtacgtacggtacttaacttacgtacgaactaaacgtaagactaacgtaagaacggttacgttaactagtaggtttaacgggtcgtaccggggacggtaacgggtacgtaccgtacggtcggtaaccccggttcgttaaccggtacgtaacccggaccccgttaacggggccttcccggtaccccgtccggg

SEQ ID NO: 202594 - DNA, 694 bp, Homo sapiens
  misc_feature: GYAE6OF02HYGJ2.21.46.E02.1.454.CMB.1.raw
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccacccgtcggtgtcagtcgtccccaggacaggaccggccaggactccacctgtcctcgtgcagtatcggaactcgaccaaaagtaatatagtactttaattacggtacaaacgaagaacgccgaggccgacggtcccctgtgttaagngtaatataanaacggacagtagacgacggccctagaacgacgtactaccgtggacgcgtaacttccgtgtcgtccgtaccgacggtccgtacgaacggaccgtaagaccgtagtaccgacgttacgttaactacgtactaggtacgtaacggtaccgaacgggtacggacggtaacgggtaccggaggttaccgtagttaaacgtactttaaccggactaactaaacggtacgtaaacggacgtaaggtaacgtacgtacgtacgttaggttcgggttacggttcgggacgggtacgaaccgagttaccggttacgggtacccgttacggtacggacccgtacggacccgttaagggccctcccggtaccccgtacgg

SEQ ID NO: 202595 - DNA, 637 bp, Homo sapiens
  misc_feature: GYAE6OF02GEMVV.21.46.E02.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagntggactgaccaaaagaaatatgtacttagttggtaaccaacaagaagccaaggcccacggccccctgttcgttagtgaattaataataaagaacacgtgaaggtacggcccctacaagtacgactccctgacgcggatttcctcgtgcctccagctcgacgggacagctacgtctacgttgactatacagtagtaacgtccaggacaggacggaggacggtacgtacgtaacgttattaaccttacgtaacctaaaacgtaaggttaacgaaccgtaaggttaagtaacggttaaccttacggtagtttggggttacggttcggacgggtacggaacggtaacgtcggtacggtacccggttacgtacggaccggtaacacccggaaggtcccgtccggtcccccgttaccgg

SEQ ID NO: 202596 - DNA, 669 bp, Homo sapiens
  misc_feature: GYAE6OF02FO2CP.21.46.E02.1.454.CMB.1.raw
  modified_base (243)..(243): a, c, t, g, unknown or other
  misc_feature (243)..(243): n is a, c, g, or t
  modified_base (290)..(290): a, c, t, g, unknown or other
  misc_feature (290)..(290): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatntgcttattggtaaccaacagaagccaggccacggcccctgtgttagngatatataaagacactgacggaggccctagagagactccctgacgcgtattctcgtggcctccgagtcctcgaagggtacagcgaggtacctacggttacgaactagtcgtaaggtacgaacggttccgaaggcgaagggtaacggaacggacgggtctaacgtaacgttaacttacgtacggtaacgtaaaaacgtaggtaaaggtaccgtaaaggttaaggtaacggttaactacgtaacggtttggggttacggttaccggggtacggggtaacgggtaacccgtaaacggtccgttacgggtaaccccgttccggttaacgggtactaaccgggtaacccgaacggggtccccgtacccggccccccgttaccgg

SEQ ID NO: 202597 - DNA, 768 bp, Homo sapiens
  misc_feature: GYAE6OF02HN8HW.21.46.E02.1.454.CMB.1.raw
  modified_base (176)..(176): a, c, t, g, unknown or other
  misc_feature (176)..(176): n is a, c, g, or t
  modified_base (235)..(235): a, c, t, g, unknown or other
  misc_feature (235)..(235): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctctatgagctgacacagccaccctcggtntcagtcgtccccaggacacgaccggccaaggactaccaccgtgctctgacagatggacngaccaaaagaatatagtactttatacggtaaccaacgaagaacgaccgacggaccgacggtccccgtaggtagttaagtagtaacttaataaagttaaaacgtaaccgaacgttaacgacgggtaccggtaccctacgaagaacgtaacgtaccccgtaggacgacgttaattccgtacgtacggtcctaccgacgcgtaccggagggaaccagtacgacggtactacgtagtactagtacgaggtaacgaagttaccgaaggtacgaacggaacggtacggacgtacgttaaggaactttaagttaacgtacggtaaacctaaacggtaacggtaacgtaacgtaacggttaacggtaacgtttaccgtaagggtttacggtttacgggggttacgggtttaccggggaacggggaacgggtaacccgaaaggttaccgtaaccgggtacccggtttaaaccgggttaacgggtcccgaaccggtacccgggtaaccgtacccggttaccccggtacccccggttaacccgg

SEQ ID NO: 202598 - DNA, 764 bp, Homo sapiens
  misc_feature: GYAE6OF02I426R.21.46.E02.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagactcatctacagggaaagggggtggtccaggaggcagaactctgggtgtctcaccatggcctggatccctctacttctccccctcctcactctctgcacgnggctctgacgcctccgtatgagcttgacacagcccacccgtggtcgtcaggtccgtccccgagggaccaggaccggccaagggactccaacccgttgccgttcctagcctaaggattcgggaactcgaaccaaaaaggtaatcgttgtactttagttacggtaaccaaacgtacgaacgtccgacggtcccgacggtccccgtggttcgttacggtagtagttaactaacgtaaacgtacgtaaccgtggtaaggaccgtcccgttagacggtaacgcttccccgaggccgtacgtacttccgtcgtacggtcctaccgagtcctacggaacggtaccagtcgaaccggttccgtaacggttcgaccgttaacgtacgtacggtaacgtacggtaccgtacgggaaccgtacgggaacggacggtacggtaccgtacggttaaccttacgtttacgttacgtacgtaaacgtaggtacggttaaccgtaaggttacggtaacgttaccgtaggttacggttgggttacgggtaccggtacgggtaacggtaaccgtaaggtccgttaaacggtcccggttacgtacggtccaaccggtccggtaacgccgtttccgaccccggttacg

SEQ ID NO: 202599 - DNA, 691 bp, Homo sapiens
  misc_feature: GYAE6OF02JS0IY.21.46.E02.1.454.CMB.1.raw
  modified_base (215)..(215): a, c, t, g, unknown or other
  misc_feature (215)..(215): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgaccacacgccctaccctcgggtgtcagtcgtccccaggacagacggtccaaggtntccacctgctactgcagatcggactggaccaaaggaactatgtacttattacggacctaacgagagccacggacctacggcccctgttaggttacgtagaagtactaagtaaaacgctaacgtgaacggtaccggcccttacgaggtacgtactccccgtgaacggtccgtactctacgtgccttaccgagtccgtacggacggaacgtacggtactacgggttactaccggttgtaacgtagtaccgtagttacgggtaaacgtaccggaacggtacggaacggaacgggtacggaccggtagtactaacggttaaccgtttaacgtacgtaaaccgaaacgtacgtataaccgtaagtaacgtacgttaccgtagtaacggttggtaggtttccgggaggtacggtacgtaacggcgttacggaacccgttcggtacgtacgacgaccgttagacccggtccgtacccgtccgg

SEQ ID NO: 202600 - DNA, 757 bp, Homo sapiens
  misc_feature: GYAE6OF02JK2RC.21.46.E02.1.454.CMB.1.raw
  modified_base (251)..(251): a, c, t, g, unknown or other
  misc_feature (251)..(251): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctagtcgagcctgacacagcccacctcggtgtcagtcgtccccaggacagacggctaggactccaccgtgcctcgtgcagatcggactgaaccaaagtaatnttcggtactttagtacggtaccaagtacgaacgccggtacgaccgaccggtaccgttgttacgtaggtacgtaacttaacgtaagtaaaccgtacctaggtaacgaccggtacccgttcgtaacggacgttaacgtcccttccggagtccgtacgtttaccgttcgtacggtcgaccgttacgacgttacgaggtaccgagtaccgtacggtacgtaccgttagtaccgtacgttacacggttagtaaccgtccggtacggtacgacgggtacggacgacgttcggactttaaccgtacgttaacgttacgtaacgtaaaccggaacgtaaggtcccgtaaaggtacgtacgggtaacgttcttaacggtttacgggtacggttacgggtaccgggaacgggttacgacccgtttaaccgggttacctccgggtacccgttacgtacccgggtaccgtaacgggtaacccgttcggtacccccgttcccggttacccggttaacgg

SEQ ID NO: 202601 - DNA, 699 bp, Homo sapiens
  misc_feature: GYAE6OF02I1401.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacgccaggactcacctgctctgcagagtggactagaccaaaagtaatatgtactttagttcggtaaccaagagaacgccgaggacccacggtcccctggttacgttagtacgaattatagtaaaagctacgtggaggaccgcctacagacgactcccgagagctacttctcgtcggccttacgcgtccgttacgaacggggtacaggaccgtacggttacccgtaacggtttacgaaccttactacgtaggtaacgaacggttaccgagggtaccaagggaacgggaccggtaagggtccttaacggtaacctttaacgttaccgtacgtaaccgaaacgtaggtaacgtaacgagttaacggtaacgttacgtcgttaggttcggggtacggttaccggggacggaacgggtaaccgtaagggtcccgtacggttaacccggtaccgttaccggcgtaaccggtacccggaacggttcccgttaccccgcccgttccgg

SEQ ID NO: 202602 - DNA, 738 bp, Homo sapiens
  misc_feature: GYAE6OF02IP8HC.21.46.E02.1.454.CMB.1.raw
tcagtcgtcgctcgcacgaccggtgctcgatttagactcatctacagggaaaggggggtaggggtcccaggagggacaacgaactctggggtgtctcaccatggcctggatccctctacttcctccccctcctcactctctgcacaggctctggacggcctcctagtggagctgacacacgccacccgtcggtgtcagtccgtcccgaggacacggtaccggccaggacttcaccgtgtctctcgacagagtggactcgaaccgaaaagaatagtcgactttagttacggtaaccaacacgaaacgaccgacgggaccaccggtccccttggtacgtttaggtagtacgtaagtaaacgtaaaaccgactaacgtacggaaccggacgggtacccctacgtaacggaacgtaacccgttccgtaaggacgtacgttaaccgttcgtaccgtcggtaccttccgtacggtccgtacgtacgggacctacgacgttaacgtccgttacgttacgacttacgtacgtaggtacgtaacggtccgaacggaccgtaaggacgggacgggacgtcggtactaacgtacgtttacgtagtaactaacggacgtaagacggtaagttacggtacgttacgtacggtacgttggggtacgttcggggtagggaaccgtcggaacgtcggtacggtacggtacggtacgcggtacgacccggtacgtccgtacccggtacccgtcgg

SEQ ID NO: 202603 - DNA, 840 bp, Homo sapiens
  misc_feature: GYAE6OF02H6912.21.46.E02.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagactcatctacagggaaagggggtggtccaggaggcaggaactctgggtgtctcaccatggccctggatccctctacttctcccctctcactctctgcanggctctgaggcctcctatcgagctgacacagtcccacccgttggtgtcaggttcgtccccgaggtacaggaccggccgaggactccacctgactcgtgacagtgtaggacctggaacctaaaagtaattctagtactttattacgttaaccaaacgtacgaacgtaccgacggaccgtacggtaccccgttaggttacggttaacgtacgtaacgttaaactaacgttaaaacgtacctaacgtaggtaacggtaccggtaccccgtacgaacggaacgttaaccgtccccgtaggaacggtcgtacgtttccgtcgttaccggtccttacccgacgtacgttacggacgggtaaccgtacggtaccgtacgttccgtacggtttacgaacgttacgtaaccggtaagttaacggtaaccgttaccggaaggtacccgaaagggtacgggtacggtaacggttaccgttacgttaacgtaacgtttacgtacggtaaacctaaacggtacggttaacgtacgtaggttaacggtaacggtttacgttacgtaacgggtttagggttaccgggtaccggggtacgggtaaccgggtaaccgtaacgggtacccggttacggtaaccccgggttacgttaaccgggacgttaaccccgggacccgggttaaccggtcccgttaccccgggtccccgtttaaccccggg

SEQ ID NO: 202604 - DNA, 677 bp, Homo sapiens
  misc_feature: GYAE6OF02IAX4G.21.46.E02.1.454.CMB.1.raw
  modified_base (319)..(319): a, c, t, g, unknown or other
  misc_feature (319)..(319): n is a, c, g, or t
  modified_base (327)..(327): a, c, t, g, unknown or other
  misc_feature (327)..(327): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagcctgacacacgcccacccgtcggtgtccaggtcgtccccgaggacacggaccggccgaggactccaccgtcgctcgtacgcagagtcggactcgaaccaaaagaatgtctacttacgtaggtaaccaacgagaacgccaaggccacggtccctgtgttangatataanaagacactggacgtacgacctgagtacgtacgtcctagacgtacgtacttaccgtctcggacctacgacgtcgacgaacgggacctacgggactacgtacgtacgttcggacttacgtacggagttaagaccgtacggagacgaacgggacgggtagacggacgtttagtaacttacgttacgtacgtaaactaacgaacggtaacgaacgtacgggttaacgtacggttaacgtacgttagggtcgggttacggtaccggacggggttaacggaccgtaaggtccgtcggtacccgttacggtccggtaacgccgaacccggtacggcccttcccggtacccctacggg

SEQ ID NO: 202605 - DNA, 854 bp, Homo sapiens
  misc_feature: GYAE6OF02H90XQ.21.46.E02.1.454.CMB.1.raw
tcagtcgtcgctcgcacgaccggtgctcgatttagactcatctacaggggaaagggggtgggtccaggaggcagaactctgggtgtctcaccatggcctggactcctctacttctcccctcctcactctctgcacgaggctcgtggacggccttcctatcgagctagacacacgccctacccgtcggtgtcacgtcgtccccgaggacaggaccggaccgaaggactccgtaccgtcgtcctacgtcgcgacgtagtcgacgtacgaaactaaaagtaactcgtgttactttagttacggtaaaccaacgagaacggtaccgaaggcccgaccggccccttagttacggttaacgttataacgttaataaacgtaaacgtaacgtaacgtaggtacggaccggtcctaacgtaacggtacgtaaccgtccgaggacgtacgtaacgttccgttacgtccgtactaccgtacggccgtaacggacgggacctacggaccgtaacggttaccgtaacgtttaccggaactcggttaccgtaaacggttaccggaaacggttacgggaacggtaccgggtaacgggtaaacggggtaacgtaaccgggttacgttacgttaaacgtttaaacgttaacgttacggtaaaaccttaaacggtaacggtaacgtaaacggtaacgggtaacggttaacgggttaacgttcggttaacgggtttaaccggggttcgggttacggggtaaccggggtacggggtaaaccacgggttacccggtaacgggtacccgtttaacggtccgggttaaccaccgggttacccggaacggttcccgtaccccggttacccgtcccgg

SEQ ID NO: 202606 - DNA, 803 bp, Homo sapiens
  misc_feature: GYAE6OF02FW8NT.21.46.E02.1.454.CMB.1.raw
  modified_base (176)..(176): a, c, t, g, unknown or other
  misc_feature (176)..(176): n is a, c, g, or t
tcagtcgtcgctcgcacgaccggtgctcgatttagactcatctacagggaaagggggtgggtccaggaggcagaactctgggtgtctcaccatggcctggatcctctacttctccccctctcactctctgcacaggctctgaggcctctatgagctgacacagtccacccgtggtntcagtcgtcccaggacagacgcaggatcacctgcctctgcagatcggactcgaccaaagtaaatcagtacttagttacggtaaccaacgtagaacgtaccgacggccgtaacggtcccccgttaggttacggtttagttagtaacttaagttaaactaaaaacggtacctaaggtacggaaacggaccgggtaccccgtacgtaacggacgtaccgtaccttacggaacggtacgtactttcgtaccggtacggtacccgtaccgtaacgtccgttaccggaaacggggtaccgtacggtaccgtaacgttaccgttaaccggttaacgacctttaacggtaccgttagggtaacgtaaaccggttaccgaaaggggaccttaaagggggaacggtaaacgggtacggttacgtacggttaacttaaccttacgtacgttaaaccgaaagttaaacgtaacggtacgtaaacgggttaacggaacggtaaccgtttactaaggggttttcggggttaacggttccggggagggttaacgggaacgtaacggtacggtaaccggtacgttaccggtagtaccggaacggttacccgaacggtcccgtacccggtcccggttaccccgg

SEQ ID NO: 202607 - DNA, 901 bp, Homo sapiens
  misc_feature: GYAE6OF02ILMWE.21.46.E02.1.454.CMB.1.raw
  modified_base (243)..(243): a, c, t, g, unknown or other
  misc_feature (243)..(243): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacggcctcctatggagctgacacacgcccacccgttcggtgtccgtaggttccgtacccccgaggaccgacggaccgggacccaggtaactccaccgtncgttctcgcacgtagtcggaaccttacggaaccaaaagtaaattacgtcggtactttagttacggtaaccaacgtaacggtaacgaccgtaacggccgaaccggtccccgttaggttagttaacgtagtaagttaacttaaacgtaaacgacctagtacgggtacggtaccggtaccctacgaacgtaacgtaccgttcccgtaaggacgtaccgttacttccgtacgttccgtaccgaccgtacggtaccgttaacgggacgggaaccgacggtacgtaaccggttacgtacccggtttagtaacttaacggtacgtaacgggtacggtaaacgtccgggaaacgtaccggtaagggtaccgggtaaccgggtacggttacgtaacggttaaccttaaacggtttaccgttacggtaaaccctaacggtaacgtaacgggttaaccaaggggtttaacggtaaccggttacgttaaccgggtttagggttacggggttaccggggttaccgggtaacggggaacccggggtaaccgtaaccgggtacccggttaccgggttaaccccggttaccggtttaacggacccggttaaccccggaacccgggtttaaccgggtaccccgttacccccggggttacccccgtttaccccggg

SEQ ID NO: 202608 - DNA, 600 bp, Homo sapiens
  misc_feature: GYAE6OF02H0O1O.21.46.E02.1.454.CMB.1.raw
  modified_base (175)..(175): a, c, t, g, unknown or other
  misc_feature (175)..(175): n is a, c, g, or t
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctgacacagccaccctggtntcagtcgtccccaggacagacggcaggatcacctgctctgcagctggactgaccaaagaactntgactttatacggtacaacagagccaggcacggcccctgtgttacgtgactataagtaagacacgtgagtacggccctnaganacgtcctgacgtcgtattcctctcggcctcagcctagacggacngcagtctacgttgacttagtacgagtcgtaacgtcgaacggagaggtaggaacgaggtacgtacgtaacgttaagttacgaggtaacctaaaggacggttaagacgtaagttaacggacgtttacctacggtagtttacgggtagggttacggacgggtacgggaacgtaacggccgttaggacccgttacgacggttcaaccggaccgtaaccggtctcccgtaccccgtacgg

SEQ ID NO: 202609 - DNA, 727 bp, Homo sapiens
  misc_feature: GYAE6OF02F4KX7.21.46.E02.1.454.CMB.1.raw
  modified_base (165)..(165): a, c, t, g, unknown or other
  misc_feature (165)..(165): n is a, c, g, or t
  modified_base (273)..(273): a, c, t, g, unknown or other
  misc_feature (273)..(273): n is a, c, g, or t
  modified_base (342)..(342): a, c, t, g, unknown or other
  misc_feature (342)..(342): n is a, c, g, or t
  modified_base (360)..(360): a, c, t, g, unknown or other
  misc_feature (360)..(360): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacngccacctcggtgtcagtcgtccccaggacacgacggccaggatccacctgcctctgcagatggactgaccaaagtaactatgacttattacggtaaccaagacgtacnccgaggccgacggccctagtacgttagtagtataacttaataaacgacctagtggaggacggtccctanagtacgtactaccgtagnggacgtactttccgtcgtcggtcctaccgtagtaccgtacgaacgggactacgcgtacgtaccgtacgttcgtaacctagtcgaagtcggtaacttcggagacggtaggaacgggtacggacggttactacggtaacgtttacttaccgtacgtaaccgtaaactacgggtaagtaacgtaagttaacggtacggttaacgtccgtttaaggggttcgggtttacggggtacccgggacggggttaacccgggaaccggttaaccggtccggtaacccgttacccgggtaaccggttaccgggtaaccgtacccggtacccggtaaccgggtacccctttacccgggtccccccggtttaacccggg

SEQ ID NO: 202610 - DNA, 669 bp, Homo sapiens
  misc_feature: GYAE6OF02F06E7.21.46.E02.1.454.CMB.1.raw
tcagtcgtcgctcgcacgaccggtgctcgatttagactcatctacagggaaagggggtgggtccaggaggcaaaactctgggtgtctcaccatggcctggatccctctacttctccccctcctcactctctgcacaggctctgaggcctcctatgagctgacacagcccaccctggtgtcagtcgtccccaggacagacggccaggatcacctgctctgcagatggactgaccaaagaatatgacttatggtaccaacagaagccaggccacggcccctgtcgttagtgagtataagtaaagacactagagacggccctagagacgactcccgtagacgcgtattcgtcgtcggctccagcgtacgacgggaactaggacctacgtaccgtaacggtttacggacttacgtacgtaaggtacgtaacgttaccgagggtacgaagggaacgggaacggacggtacgttacggtacttaacgtttaccgtacgttaacaaacgtaggttaacgacgtaagtagaacggttaactacgtaggtttcgggtacgggttacgggaccgggacgggtaacgtaacgggtcgtaccgggtacccggtacggttacggtaccgaaccggtacccggaacgggttcccgtcccggtaccccgttacgggttaccccg

SEQ ID NO: 202611 - DNA, 768 bp, Homo sapiens
  misc_feature: GYAE6OF02JDLPV.21.46.E02.1.454.CMB.1.raw
  modified_base (178)..(178): a, c, t, g, unknown or other
  misc_feature (178)..(178): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtntcagtcgtccccaggacagaccggccaggatcgacctgctctgcagatggactggaccaaaagaaatactgactttagttcggtaaccaaccaagaacgaccgaggccgaacggccccctgttcgttagtgatataagtaaaacgacacgtagacgacggccctacgacgagacgttccccgtagacgtacgtaactttccgtcggtcggtccttacccgacgtacccgttacggaacgggtaccgaggaccgtacggttaccgtaaccggtttggtaaacctacgtacgtaagggtacgtaaaccggttccggaacgggaccgtaagggaacgggtaccgggtacgggtaccggtacgttaaccgttaacgtttaacgttacgtaaccgaaaacggtacggtttaacggaacgtaacgggttaacggtacggttaacgtttacgtagggttttacggggttacgggtttaccggggacgggttaacgggaacccggtaacggttccggtacggtaccccggttaaccggttaggcccggttaacggacccggtaacggtccccgttacccggtccccccgttaaccggg

SEQ ID NO: 202612 - DNA, 837 bp, Homo sapiens
  misc_feature: GYAE6OF02IQ90R.21.46.E02.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctctatgagctgacacacgccacccgtggtntcagtcgtaccccaggacaggacggccaggactccacctgctcgtgcgagatacggactcggaaccaaaaagaatgtcgtacgttattacggaaccaacgagaacggaccgacggaccgacggtccccgtggtacggttacgtagaataacgtaagaaaacgtacaactaggaacggaccggtccctacgaaggaacgtacctccgtaggaacgtacgtaactttcgtacgtcgggtacctaccgacgtccgtacggaacgggtacaacggtaccgtacgtaccgtacgttacgacttacgtacgacggtaacggtactaccgtacgggaacgtagggtaaccggacggtaacgacggttacgtaaccgttaacgtttaaccggtagaaaccgttaaaacgtacggttaaacggtaaccgttaaacgggttaacggtaaccgggtttaaacttacccgggttaaagggtttacgggggtttaaccgggttacccggggtaacgggggtaaccggggttaaaccccgaaaggggtttaaccccgtacggggttaaacccccgggtttaacccggttaaccggggtaaccggtaacccgggttaaccccggtaacgggtacccccgggtttaccccgttaccccccggggttaacccgg

SEQ ID NO: 202613 - DNA, 788 bp, Homo sapiens
  misc_feature: GYAE6OF02IC7IZ.21.46.E02.1.454.CMB.1.raw
  modified_base (182)..(182): a, c, t, g, unknown or other
  misc_feature (182)..(182): n is a, c, g, or t
  modified_base (391)..(391): a, c, t, g, unknown or other
  misc_feature (391)..(391): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctagtgagctgacacacgcccacccgtcggtntcagtcgtccccaggacacggaccggccgaaggactcgaacctgcctcgtcgaccaggtagtcggacttcgacaaaaggaaattagttcgtactttagttacggaaccaaacgacggaacgccgacgccgacggtccccttaggtgttacgtagtattaataagtaaacggacacgttaggaggaccggccctagacgagtacgtcccngacggacctagtttcctcggtacgcccgtacgacgtacgcggaacggtacacggtcgtacgtacgttacggttacacgttacgtggtacgtaacggtaccggtcggacgtaacgggaacggtaggggtacggaccgtaggttacgtaactttacgttacgtagtaaacccgaaagttcggtaaacgtaacggtagggtaacgtttccgggtaacgttacggtttacggggtttacgggttacggggggtaccggttaaccgggggtaccggtaaccggtcgggttaacgggtaacccgggttaacccgggttacgggttaaacccggacccggggttacccggaaaccccggttccgggtaacccggtttccccccggtacccgttttaaccccggg

SEQ ID NO: 202614 - DNA, 687 bp, Homo sapiens
  misc_feature: GYAE6OF02F0QBJ.21.46.E02.1.454.CMB.1.raw
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgcctactgcagatggactgaccaaagaatatgacttagttggtaaccaactagaaacgcctaacggccaggccccctgttggttacgtgattacttaataaaggtacacttgagacggccctcagagactcccgtagacgtcgtactttcgtactcggtcctaccgtagtcttacgaggggtaaccaacgggacctaaggtaccctaacggtttacgtaacgtttaacgtactaaggtacggtaacggttccccgaaagggtacctagggaacggggaacgtagggtcctaacggtaccttaagttaccttacggttaaccaaaaccgtaacgttaagaaccgttaacggtaaggtaacggtttacgttaacgttacggtttggggtaccggtttcgggacgggtaaggtaaccgacggtaacgtcgtaaccgtaccgttaggccgacgtacccgaggccgtccgtccccgtacgg

SEQ ID NO: 202615 - DNA, 702 bp, Homo sapiens
  misc_feature: GYAE6OF02JUDRP.21.46.E02.1.454.CMB.1.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacagctctgacggcctcctatgagctgacacacgcccacccttcggtgtcagtcgtccccaggacagacggccgtaaggactcacctgctcgtacgcacgntggaccgtnaccgaaaagaactatcggtattaagttcgtaaccaacgaagaaacgccgacggtaccgacgccccgttagtacggttagttcgaattacgtaataaaacggaactacgtacgaagaccgggtacccctaacgacgtaacgacgttaccccgtagaacgtacgtaactttcctacggttaggcccttaccgtagtccgtacggtaacgggtaaccgacgaccgtacggttactcgttaaccgtaattacgtcgaaggtttagaaaccggtacgtaggacgaacggaacggtacgaaggtcgtaacgaatttacgtacttagtaaccgtaaacagtacgacgtagtaaggtacgttactggtagttgggtacggtcggtacgggacgtaccgaaggttactcggaaccgttcgaacggttacgaccgtaccggtacggtaccctccggtaccccgttaacgg

SEQ ID NO: 202616 - DNA, 588 bp, Homo sapiens
  misc_feature: GYAE6OF02ILAKG.21.46.E02.1.454.CMB.1.raw
  modified_base (323)..(323): a, c, t, g, unknown or other
  misc_feature (323)..(323): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgacttattacggtaccaacagaacgccaggccacggccctgtgtagtagatatataaagacactagagtacgccctgaganactcccgtgacggctaattcctacgtcggtcctccagctacgagggaccagcacgtcgaacgttgactatcgaagtgaacgtcgagcgaggacggacggacggtcgtagtacttaagtacgttagtaaccgaaagagtaacgactaaggtagtacggtactcgtaggtttcgggtaggttcgggacgggtacgggaaccgaggcgtcggtacccggtcgtacggtacacggtacccgaacggtccgtacccggcccccgtaccgg

SEQ ID NO: 202617 - DNA, 685 bp, Homo sapiens
  misc_feature: GYAE6OF02I77YV.21.46.E02.1.454.CMB.1.raw
  modified_base (247)..(247): a, c, t, g, unknown or other
  misc_feature (247)..(247): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagccacccgtcggtgtcagtcgtaccccaggacagaccggccaggatcacctgctctgcagatggactgaccaaaagaaatnagtcttattcggaaccaagagaacgccgaggaccacggcccctggtagttagtacgataataagtaaagactaactgaacggtacggcccttacaaggtacgactccccgtaggaagtcgtatttctacgtcggcctacgcacggtccgaagggaccaagcgtaaggtacctaacggttagtaccgtaagtctaaagggttcgaaacgttaccgaacggtacggaacggaaggggaaccgagggtaaccttagggaaacttaacgttaccgtaacgttaaccgaaacgtggtaaaccgagtaaggttagaacgttacgaacggtagtttcgggttagggttaccgggcggtaacgggtaaccggtaggacgtacgtaacccgtacgggtacgttaccgaccggtaacccgaaggtcccgttacccggccccgtacggg

SEQ ID NO: 202618 - DNA, 595 bp, Homo sapiens
  misc_feature: GYAE6OF02HY5JM.21.46.E02.1.454.CMB.1.raw
  modified_base (177)..(177): a, c, t, g, unknown or other
  misc_feature (177)..(177): n is a, c, g, or t
  modified_base (338)..(338): a, c, t, g, unknown or other
  misc_feature (338)..(338): n is a, c, g, or t
  modified_base (381)..(381): a, c, t, g, unknown or other
  misc_feature (381)..(381): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtntcagtgtccccaggacaaacggccaggatccacctgctcgtggagattcattgaccaaaaagatatacttgttggttccagcagaagtcaggccaggcccctgtactggtcatccatgacggcagtcgacgacacgtccgggatcccgtgagacgatttcncgtcgccctcgacgtctcgaggacaggtcgcctacttgactancgaggtcgggccgagggtacggacgagtaggaagacgtgactacttattacgtacgcctaaccgagactaggttaggtcgtactagtacgtagggggttacgttcggggacggacgggaccgtaaggttcgtaccgttccggttggcgtacgaccgtaacggtcctccggtcccccgttcggtccctaccgtccgttccgttccccgtaccccg

SEQ ID NO: 202619 - DNA, 672 bp, Homo sapiens
  misc_feature: GYAE6OF02G3KQJ.21.46.E02.1.454.CMB.1.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctctatgagctgacacagccctacccgtggtcgtacagtcgtccccaggacagacggccaggatcgactgctcngcagactggactgaaccaaaagaatntgtacttatacggtaaccaaagagaacgcgaacggccaacggccccgttgtagttacgtagtaatataaataaacgacacgtaggagacggtcccacgagaagtacctccgtagaacgtcgtacttctacgttcgacctcgaacgtcgtagaacggactacgcgtaacgtacgtacgtttggaacttaggacttaaggtacgtaaacgtaccggaagggccaaggggaaccggtaaggtacggccgtaaggttaacttaactgtaacctacgaaacgttaagaagtaacgtaagggtaacgtaacgttactcgggttaagttgggttacgggttccgggacgggaacggtaccgtaaacgtcggtcgtaaacccgtttggaacggaccgtacgtacccggaggcccgttacccgcccggttaccgg

SEQ ID NO: 202620 - DNA, 583 bp, Homo sapiens
  misc_feature: GYAE6OF02JICSY.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatntgcttattggtaccaacagaacgccaggccaggcccctgtgttagtgatatataaagacactgagaggccctacagagatccctgagcgattctcttggcctccgagctacgagggacagcagtccagttgactatcagtagaacgtccaggcaggacggacgaggctagacttattaacgtgtacaaacgtagtaagacctaaggtacggaaggttactagtaacgtttggggtagtttccgggacgggtaacgggaccgtaaaggtccttagggtaccccgttcgttaagggtccaacggtacccgtaaaggtcccgtaccggtccccccgttaccggg

SEQ ID NO: 202621 - DNA, 664 bp, Homo sapiens
  misc_feature: GYAE6OF02H64IV.21.46.E02.1.454.CMB.1.raw
  modified_base (246)..(246): a, c, t, g, unknown or other
  misc_feature (246)..(246): n is a, c, g, or t
  modified_base (278)..(278): a, c, t, g, unknown or other
  misc_feature (278)..(278): n is a, c, g, or t
  modified_base (354)..(354): a, c, t, g, unknown or other
  misc_feature (354)..(354): n is a, c, g, or t
  modified_base (409)..(409): a, c, t, g, unknown or other
  misc_feature (409)..(409): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacacggacggccaggactcacctgctctgcagatcggactcgacaaaagaatntgtcttattggtaccaagtagacgccaggccncggaccctgtagttagtgatataataaagacacgtagaggacggtccctagagacgtactaccccgtgacgacgtnttaccgtcgtcggtcctcgacgctacgacgggtacagccgtagtactacggtttnaacttacgtcgaagttacggaaccgttacggagtacggaggacgggaacggacggtcgtacgtaacttacgtttaacgtacgtaaccgaaacgtacggtaacgacgtaaggtaacgttaacggttaacgttcgtagggtttgggttacggttcgggaacgggtacgggacccgacggtaccgttaccgggacccgtttaccgaggtacggacccgacccggtaaggtaccccgttcccggtccccgttacccggg

SEQ ID NO: 202622 - DNA, 755 bp, Homo sapiens
  misc_feature: GYAE6OF02JWYOK.21.46.E02.1.454.CMB.1.raw
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
tcagtcgtcgctcgcacgaccggtgctcgatttagactcatctacagggaagggggtggtccaggaggcagaactctgggtgtctcaccatggcctggatccctctacttctccccctctcactctctgcacaggtctctgaggcctctatgagctgacacagtcccacccgtcggtgcagttccgacccgaaggacaggaccggccaggtntaccgacctggccttcngtacgagtacgtacggacgtcaaaccggaaaagtaactcgtacgttaactttagttacggtaaccgaacgaaggaacgtaccgtaaccggaccgtacgggtcccccttaggtacggttagtacgtaagtaacgtaaagttaaaccgaaccgtaagtcgggaacggtcccggacccgttaacgaaggtacgtacgttacccgtaaggtaagtccgtaagtttccgtaccggttcggtaaacctccgacgtaccggtaccggaggggtaactaccgtacggtacggtaccgttacggttaacgtacttacgtaccgtagtacggacgtaccgaggtacgacggtagaacgtgtagtaacgattactacgtacgtaaccagtaacgtaagtacgtaaaggcgtaacgttaccgtaggtacggttaggtacgggtacggacggggtaccgtacggtacgtacggtacgtaacccggttccgtacgttaccgaccggtaccggttaccggtcccgtcccgtccggtacccg

SEQ ID NO: 202623 - DNA, 773 bp, Homo sapiens
  misc_feature: GYAE6OF02HD667.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccgaggaggcagaactctgggtgtctcaccatggcctggatccctctacttcctccccctcctcacctctctgcacgaggctctgaggccctcctagtgagctgaacacgacgcccacccgttcggtgtcgagtccgtccccgaggacgacggacggaccaggtactccacctgcttcgngaccagaatcgggactacgaaccgaaaaagtaaattgtacgtacgtttaacgtacggttaacccaaacgaacggaacgaccgaaccgggaccgaccggtcccccgttggttaggttagttaggtaattaattaaaacgtaaaacgtaacgtaacgtacggaaacggaccggtacccgttacggaagtaacggtaccttcccggaggaacggttcgtaacgtttccgttcggtcggttacctcccgtaacgtccgaacggaacggacgacgtcgacgtacgtacggttagtactacgtagtagtacggtaacgtaccgagggaacgaaacgggaaggaacgggtacgcgttacgtaaaccgttagttacttaacggaaaccttaaagggtaaaccgtaagtacgaaggttaacgacgtttaactacggttaggtacgggttggaccggtagggaacggaacgtacgggtactaccgggaaccgttccgaacgtcggaacctaccggaacggttcgaccccgttccgtacccg

SEQ ID NO: 202624 - DNA, 709 bp, Homo sapiens
  misc_feature: GYAE6OF02FS4ZQ.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctccccctcctcactctctgcacgaggctctggacggcccttcctatgagctgaccacacgcccacccgtggtcgtctagtcgtccccaggacacggacggcgaggtatccacctgctctgcagagtcggactcgaaccaaaagaaatatgtactttagttacggtaacccaagaagaacggaccgacgggcccacggtcccctggttcggttagtagaattaataagtaaaggacctacgttaggacggtacgtaccccgttagaacggtaacgtaccgtaccccgttaggacggtaccgttacgttttccgtcgttccgggtccttacccgagtccgtacggaacgggaacgacgtacgtacggtaccttaacggttacggtaacttactacgtaaggtacgtaacggtacccggaggacgaagggacgggacggtaggtacgtacgttaactgtttacgtacaacgaaacgtagaacgtacgtaggtaacgaggttactcggttaggttgggtacgtcgggtaggaacggaacgagtcgtacggtaccgtcgtaacggactacggaccgtacgtcgtcccggcccgttaccg

SEQ ID NO: 202625 - DNA, 844 bp, Homo sapiens
  misc_feature: GYAE6OF02HEZLV.21.46.E02.1.454.CMB.1.raw
  modified_base (132)..(132): a, c, t, g, unknown or other
  misc_feature (132)..(132): n is a, c, g, or t
  modified_base (144)..(144): a, c, t, g, unknown or other
  misc_feature (144)..(144): n is a, c, g, or t
  modified_base (155)..(155): a, c, t, g, unknown or other
  misc_feature (155)..(155): n is a, c, g, or t
tcagtcgtcgctcgcacgaccggtgctcgatttagactcatctacagggaaagggggtgggtccaggaggcagaactctgggtgtctcaccatggcctggactccctctacttcctcccctcctcactctcngcacaggctcgngacgcctctangacgtctagaacacacgtcccaccgttggtcgcacgttccgtacccgaggacgacggaccggacgtaaggactccacgttgccttacgtcgacagtagtacggacacgaaaccaaaagtaaatgtacgtattacggttacgaacaacgagaacgacgacggccacggtccttagtaggttacgtagtaataaagtaaacgtaaacgaccagtacggaaccgtaccggtacccgaagaacggtaacgtacctaccgtaggacgtacgttaactttcggacgtacggaccttaccggaagccggtaaccggaaggtaacaacggccgttaacggtaccgtttaacgggttcgtaactaacggttaccgtaagggtaacgtacccgttaggaaccggaggtaaacgggaacgggtacggtaacggaccgttaaacgtaacgtttaaccgttaacgaccttaaaaacgggaactaaacgggttaaccgtaacggaacggtttaaacgggtaacgtttaaacgttacgggtaaagggttttccggggtaacggggttaccgggaaaccggggaaccgggtacccgttaaagggccccgggttaaaccgtaccccgggttaaggtttacccggaacccggtaacccggaccggttaacggtcccggtacccccgggttaccccgttaaacccggg

SEQ ID NO: 202626 - DNA, 639 bp, Homo sapiens
  misc_feature: GYAE6OF02F71VJ.21.46.E02.1.454.CMB.1.raw
  modified_base (397)..(397): a, c, t, g, unknown or other
  misc_feature (397)..(397): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaaatatgtacttagttggtaacccaacaagaacgccaaggccacggccccctgtgttagtgatataataaagacactgagaggccctagagagactcccctagacgcgattcctcgtcggtccttccgagtcctcgaacgggacagctagtccacggttnaactatcgagtgaacgtccgaggcaaggaggacgaggtcagtacgttatacgtagtaccaaacgtagtaagacgtaagtaggtacgttaacctagtaggttagggttccggtacggggtacgggaacggggtaaccctaagggtccgttaccgggtaacccggtttaccggttaacgggtacccgtaccgggacccccggtaaagggtccccgttacccccggtaccccccgttaacccggg

SEQ ID NO: 202627 - DNA, 682 bp, Homo sapiens
  misc_feature: GYAE6OF02G8ZDS.21.46.E02.1.454.CMB.1.raw
  modified_base (242)..(242): a, c, t, g, unknown or other
  misc_feature (242)..(242): n is a, c, g, or t
  modified_base (334)..(334): a, c, t, g, unknown or other
  misc_feature (334)..(334): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaaatntgtacttagttacggtaaccaacagaacgccgaggcccacggcccctgttgttagtgtatataataaagacactggaggacgccctagaganactcccgtgacgtctacttctcgtcggcctccgacgccttacgagggacctacggcgtacggtaccgtaacgttcgtacttacgtacgtaaggttacggtaaccgtccggaacggacggtaaggaacgggaccggacggtcttaggtacttaacgttacgtacggtaacaaacgtaggttaacgaacgtaaggttaaggtaacggttactaggttacggttcggggttacggttaccggggtacgggaaccgggtaccgtaacggtccggttacggtacccggttaccgttacggtaccgtaaccgggtcccgtaaccgggtcccgtacccggtccccccgttaccgg

SEQ ID NO: 202628 - DNA, 685 bp, Homo sapiens
  misc_feature: GYAE6OF02I75LK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggactcacctgctctgcagatggactgaccaaagaaatatgtactttagttcggtaaccaacagaacgccgaggccacggcccctgtgttagtgatataataaacgactacgtgagacgtccctagagagtactcccgtagacgcgtactttcgtacgtacggtcctaccgacgtaccgtacggaacgggaacacggtcccgtaaggttcccgtaacgtttcggaaacttacgtacgtaacggttaacggtaacgttcccggaaagggaccggaagggtaacgggacggaggttaccgtacgtaacgttacttaacgtacgtaaccaaacgtaaggtaacgacgtaaggtaagtacggttacttaggtaggttgggttacgggtcgggacgggtaacggtaaccgtacggtacgtaccggtaccggtaccgtaggacccgtacggaacccgtacggtcccgtacccggcccccgttacgg

SEQ ID NO: 202629 - DNA, 812 bp, Homo sapiens
  misc_feature: GYAE6OF02FHOBE.21.46.E02.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtntcagtcgtccccaggacacgacggccaggactccaccgtgcctctcgcagacgtcggacctgaaccaaaagaaattagtcgtacttttagtcggtaaaccaacgaacggaacgcccgaagggcccgaaccgggtcccccttgggttacgtttacgtacggtaattaacgttaaacgtaaaacggacctacgtaggaacggtaccgggtcccctagaagtacgaccttccccgtagacgtccgtaactttccgtccgtcggtacccttaccgacgtcctacggaacgggaacctacgaccgtaacggtaccgttaacggttactaacgtttacgacccgtaaggttaaccggtaacgggttaccgaacggggtaccgaaacgggtagggaaacccgggtaggttcctaaacggttaacctttaacgttaaccggttacgtaaacccgtaaaaggtacggtaaacgtaacgtaaacgggttacggtaacggttaaccacgtttaacgggtttcgggtccggggttacgggacgggtaaccggtaaccgtaacgggccgttaccggtaacccggtttacgaccgggttaacgtacccggacccggtaaggtcccctacccggtaccccgtaccg

SEQ ID NO: 202630 - DNA, 769 bp, Homo sapiens
  misc_feature: GYAE6OF02FP7WU.21.46.E02.1.454.CMB.1.raw
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgttcggtgtcacgtcgtccccgaggacacggaccggccaggactcacctgctctcgcagagtcggactggaaccaaaagaactntcgtacttaattacggtaacctaanaacgaaacgaccgaggaccgacggtacccctaggttcggttaagtacgtaattaacttaaagtaaaaacggacctaacgtaggaacggtacggtccccgtacaaggtaacgtaaccgttccccgtaggtaccgtacgttacctttacgttcgtccggtacccgttaccgacggtccgtacggtaacgggaaccacgggtactaccggtacgtaccggttacgtaaccgttaatacgtaaggtacggtacgttaccgaggacgaacgggtacggaccggtaaggtaccgtacgtaacgtttaacgttaacgacgttaactaaacgtaacggtaaacaaacggtaagtaacggtaacggttaccttaacgttagggttacgggttggtaacgggacgggaacggaccggtaaggtcccgttacgggaacccgttacgtaacggtaccgtacgtaacccggacgtccggtacccgtaccccggttacgg

SEQ ID NO: 202631 - DNA, 610 bp, Homo sapiens
  misc_feature: GYAE6OF02FMBZ2.21.46.E02.1.454.CMB.1.raw
  modified_base (261)..(261): a, c, t, g, unknown or other
  misc_feature (261)..(261): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
tcagtcgtcgctcgcacgaccggtgctcgatttagactcatctacagggaaaggggggtgggtccaggaggcagaactctgggtgtctcaccatggcctggatccctctacttctcccctcctcactctctgcacaggctctgaggcctcctatgagctgacacagcccaccctcggtgtcgagtgtccccaggacagacggcaggatcacctgctctgcagatggactggaccaaagtaatatgacttattggtaccaanagaagccaaggccgaggccccctagtgttagtgtaatatataaacgacactagagaacggccctacagagactcctggagccgtactcgtctcggtacctcgacgctcgaagggacncgctacggtcacggttcgactacncgagtgaacgtacgnggacagacggtacgagtctagacttactacttgtacaaacgtaggtacgaagtagttagaacggttacctacgtaagttgggttacggttcgggacgggtaacggggaaccaacgggtacgtaacggtacccggtttaccgtagggtacccacggtaaccccgaaggtcccgtacccgtcccccgttaccggg

SEQ ID NO: 202632 - DNA, 914 bp, Homo sapiens
  misc_feature: GYAE6OF02GKI6G.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggccctcctagtgagctgaccacacgcccacccgttcggtgtccgaaggttccgtcccccgaaggaccaacggaccggacccgaaggacttcccgacccgttcggtccttcctgggccaacggttatcggggtacctacggaaacctaaaaggtaaattcgtacggtcgttttaagttaccggtaaacccgtaaaacgaacggtaaacgacccggaacgggaccccgtaaccgggtccccccgtttagggttacggtttaacggtacgtaagttaacgttaaaaggtaaaacggtaaccgtaacggttacgggaacggtaaccggtccccgttaacgaaacggtacggttaaccgttaccccggtaaacgggtaccgttaaccgggttaacttttcccggtaccggtttaccggtcccgttaccgtacggtacccgtacggtaaccggggtaacctaacggtacggttacgttaccgtacggtttaaccgtaaccttaacggttacggtaacggttaccgtaaacgttacccgggaaggtaccggaaacgggaacgggtacggaacgggttcgtaacggtacgttaacgttaccgtaacgtaacgtaaacgtagaaggtaccgttaagggacgttaacggtactacggttgggtttacggtgggtaccgggtagggtaaccgggtacgtaacgggtcccgtacggttacccgtacggtttacgaccggtaccggtaccgtacgggtcccgttacccgtccccggtacgg

SEQ ID NO: 202633 - DNA, 808 bp, Homo sapiens
  misc_feature: GYAE6OF02G7BN9.21.46.E02.1.454.CMB.1.raw
  modified_base (83)..(83): a, c, t, g, unknown or other
  misc_feature (83)..(83): n is a, c, g, or t
tcagtcgtcgctcgcacgaccggtgctcgatttagactcatctacagggaaagggggtgggtccaggaggcagaactctgggngtctcaccatggcctggatccctctacttctccccctcctcactctctgcacaggctctgaggcctcctatgagctgacacagcccaccctcggtgtcaggtcgtccccagggacaggacggccgaggactcacctgctctgcagtactggactggaaccaaaagaaactatgtacttaagttcggtaaccaaacgaaggaacgaccgacgggtacccgaacggcccccctggttacggttaacgtggtaacttaataagttaaaagacctacgtaggaacggtacggtccctacgaacggacgtacgttaccccgtaggaacgacgttacgtttacctccggttagggtcccttaccgacggtccgtacggtaacggggacctacggacctacggttaccgtacgttacgggtaccttaacgtaccgtaagggttacggaaccggttaccgaacgggtaccgaaggggtaacgggaaccgggtacggtaaccttacgggtaacctttaacgttacgtacggttaacctaaaacgtacggtaagaaccggttaaggtaacggttacggttaacgttacggttagggttacggggtttacggtacggggtacgggtaacgggtaacccgagggttaccgtaacgggtaacccggtttacgggtaaccggtaccggtaccggtacccgtaaccggggtcccttaccccgggtccccgttaccccggg

SEQ ID NO: 202634 - DNA, 667 bp, Homo sapiens
  misc_feature: GYAE6OF02HFNJ8.21.46.E02.1.454.CMB.1.raw
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
tcagtcgtcgctcgcacgaccggtgctcgatttagactcatctacagggaaagggggtgggtccaggaggcagaactctgggtgtctcaccataggcctggatccctctacttctccccctcctcactctctgcacaggctctgacggcctctatgagctgacacagccaccctggtgtcagtcgtccccaggacagaccggccaggntcacctgctctgcagatggactgaccaaagaaattntgtcttattcggtaaccaacagaacgccaggccacggcccctgtgttagtgaatataataaagacacgtgagacggccctacgaagacgactcccgtaggacgcgtattcctcgtcgccgttccacgtcctacgaacgggacaggacgtacgtaccgtacggttcgtaaccttagtacgtaaggtacggtaacgtacccggaaggtaccgaaggacgggacggaggtcgtacgtaacttacgttaacgttacgtaacctaaaacgagtaaacgacgtaagtaacggtaacggttactacgtaggtttggggtacggttaccgggcgggtaacggtaccgtaaggtaccggttacggtacccggttacgttacggtaccgaccggacccgtaagggtcccgtacccggtcccccgttacccggg

SEQ ID NO: 202635 - DNA, 695 bp, Homo sapiens
  misc_feature: GYAE6OF02JQPQK.21.46.E02.1.454.CMB.1.raw
  modified_base (228)..(228): a, c, t, g, unknown or other
  misc_feature (228)..(228): n is a, c, g, or t
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctggtgtcagtcgtccccaggacagaccggccaggatccaccgtgctctcgcaagngtgggacctggaccaaaagtaatatgtactttagttacggtaaccaacaagaacgccgaacggccacggtcccctgtaggttacgtgtaattanaaagtaacgacactggaacggacgccctagagagtaccnccgtagagaccgtatttccgtcgtacggccttccgacgtccgtaggacggaacgacgtacgtacgtacgtacgtagtaccccccctatacgtacgtacgtaaccgtacgacggtacggaacggtacggaacggtaggtacgttacgtaacgttacgttaacgtacgtaaacgaacgtaacgtaacgtacggtaaggtaacggtacggttacgttacgttaggttacgggttacgggtacgggacgggaacggtacggaacgtaccgtacggtaccgttaccgtacggtaccgaccggtaccgtaccggtacccgtacccgtcccggttacccgg

SEQ ID NO: 202636 - DNA, 1123 bp, Homo sapiens
  misc_feature: GYAE6OF02FVGQ5.21.46.E02.1.454.CMB.1.raw
tcagtcgtcgctcgcacgaccggtgctcgatttagactcatctacagggaaagggggtgggtccaggaggtcagaactctgggtgtctcaccatggcctggatcctctacttctccccctctcactctctgcacgaggctctgacggcctctatgagctgacacagccaccgtcggtgtcagtcgtccccgtaggactaggaccggcctaaggactccgaacctggccttctacggcaagtacgtcgggacttcggaacccgtaaaaaggaaagttacgttacggtacgttttaagttcgggttaacccaaacgtaacggaaacggacccgaacgggaccccgtaaccgggtccccccgtaggttacggttaaggttcggtaacgtttaagttaaacgttaaaaaccggtaaccgtaacgttacgggaaacggtaaccgggtaccccgttaccgaaaggtaacggtaacctttcccccggtagggtaaacgggacccggttaaacgttttcccggttacccggttacgggtacccgttacccggaacggttacccggttaacgggaaacgggggtaacccgtaaccgggtaccggtaacgggtttacccgttaaacgggtttacgggttaaccttaacggtaaccgttaacggggttaacggttaaaaccgggttacccgggtaaacgggtacccgggtaaagggggtaaaccggggtaacccgggtaaacgggttaccggttaaacgggttaaacccgttttaaaggtttaacccggttaaaccgggttaaaacccgttaaaacccgggttaaaacgggttaaacgggtaaaccggttaaaccggggtttaaaaccggggttaacgggtttaacccgtttaacccggtttaaacgggggtttttcgggggtttaaccggggtttaaccggggggtaccggggtaaacccgggggttaaacccggtaaacggggttaacccgggttaaaccccggggttaaccccgggttttaacccgggttaaaccgggttaaccccggggtaaaccgggtacccccggggtaaaacccggggttcccccgttttacccccgggggtacccccccggttttaaaccccgggg

SEQ ID NO: 202637 - DNA, 763 bp, Homo sapiens
  misc_feature: GYAE6OF02IFORO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagctgaccacagcccacccgtcggtgtcacggttccgacccccagggaacacggaccggccaaggactccacctgctctcgacaggagtcggactcgaaccaaaagaatatagtcttatacggtaaccaacgaagaacgaccgaggacccgaacggccccgttaggtcgttagtaggaactaattaaacgtaaaacgaccagttaacggaacgtacggtaccccacgaacggtacgtaacgtcccgtgaacgtcggtaattcacgtcgactccgagtcgtacggaggacagcgtagtacgtacgttacgacgtactacgaggtacgaacgtaccgaggacgtaagggacggaacggtacggttacgtacggaacgtttaacgtcgttaggaacctaaaacgtacggtaaacgtaacggtaacgttaaggtaaccggttactacggttaacggttagggttaccgggttacgggtaaccggggtaacgggtaacccggtaaggttcccggttaaaccgggtacccggttacccggtaacgggttacccgaacccggggtacccgaacccgggttcccgtaccccggtacccccggtttaaccccggg

SEQ ID NO: 202638 - DNA, 578 bp, Homo sapiens
  misc_feature: GYAE6OF02FG32Q.21.46.E02.1.454.CMB.1.raw
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactagaccaaaagaaatntgctttattggtaccaanagaagccaggccaggcccctgtgttagtgaatatataaagacactgagaggccctnagagactccctgagcgattctactggctccagctcgagggacagcagtcacgttgacgttatcagtagaagtccaggcaggaggacgaggctagtactattctagtaccaaacgtagtaagacgtagttaagacggttacacgtaggtttcgggtacgttcgggacgggtaagggaaccgtaaggccgtacggtacccgttaccggtaacggttacgaccggacccgtaacgggtcccgtacccggtcccccgttaccggg

SEQ ID NO: 202639 - DNA, 703 bp, Homo sapiens
  misc_feature: GYAE6OF02JQP0N.21.46.E02.1.454.CMB.1.raw
  modified_base (136)..(136): a, c, t, g, unknown or other
  misc_feature (136)..(136): n is a, c, g, or t
  modified_base (165)..(165): a, c, t, g, unknown or other
  misc_feature (165)..(165): n is a, c, g, or t
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (573)..(573): a, c, t, g, unknown or other
  misc_feature (573)..(573): n is a, c, g, or t
tcagtcgtcgctcgcacgaccggtgctcgatttagactcatctacagggaaagggggtggggtccaggaggcagaactctgggtgtctcaccatggcctggatccctctacttctccccctcctcactctctgcanaggctctgaggcctcctatgagctgacanagccaccctcggtgtcagtgtccccaggacngacggccaggactcacctgctcngcagatggactgaccaaagaaactatgccttattacggttaccaacgaacgaacgaccgacggacccacggcccccgttgtacgttagttagagttataataaacggtacacttagacggacgggaccccttacgaacgtagtaacctcccgtacggtacggtacgtaacgtttactcgttcggtcctaccacggccttacggacgggaacgacggtacaccgttaccgtaaccggtttagtaaccgtaacgttacgaacggttacggtaaaccggttacgcggaacggaaccggacggtaaccggagggttacgttcgacgttactttaccgtagtaaccaacgtaacggtanaacgtagtaacggtagttaccgtaacgtttggtagggttccggttaggaccgggtaacggcgtaacggtacgtaccggaccgtaccgtaggccgacggtacccgacggtacccgtaccgcccgttaccgg

SEQ ID NO: 202640 - DNA, 521 bp, Homo sapiens
  misc_feature: GYAE6OF02G1S5I.21.46.E02.1.454.CMB.1.raw
  modified_base (184)..(184): a, c, t, g, unknown or other
  misc_feature (184)..(184): n is a, c, g, or t
  modified_base (317)..(317): a, c, t, g, unknown or other
  misc_feature (317)..(317): n is a, c, g, or t
  modified_base (380)..(380): a, c, t, g, unknown or other
  misc_feature (380)..(380): n is a, c, g, or t
  modified_base (435)..(435): a, c, t, g, unknown or other
  misc_feature (435)..(435): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtntccccaggacagacggccaggatcacctgctctgcagatggactgaccaaaagaaatatgcttagttgtaaccaacagaagccaggccgacgcccctgtgttagtgatataataagacactagagacgccctnagagactccctgagcgtacttctcgtggcctccagtctcgaggacagcagtcacgttgactancagtagacgtccagcgagacggacgagtctgactagttactgtacaactagtaanagtagtagagtactacgtagttgtggtcggcggaggaccgagtcgtagaccgtacgtagtcacgcccgagcgtaccgtcccgtacg

SEQ ID NO: 202641 - DNA, 868 bp, Homo sapiens
  misc_feature: GYAE6OF02JJP6U.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctccccctcctcactctctgcacgaggctctgaggcctcgtatgagctgacacacgcccacccgttcggtgtaccaggtccgtacccccgaggaccgacggaccggcccgaaggactccacccgtgccttctcggacaggtacgtcgggactcggaaccaaaagaaattctagtacgttaagttacggtaaccaaacgaacggaaacgtcccgacggtaccgaccgggtcccctagggttgttaaggtacgtaattaacgttaacgtaaaacggtacctaacggtacggaacggtaccggtacccttaggacggaaccgtacgttaccccgtagggaaccgtacggttacctttccgtcggtacgtcccgtacgtacggaccttacgggaacgggtacgtaccgaccgtacggttaccgtaacggttacgtaaccttacgtacggtaacggtacggaacgttccgaacggacggaacgggtaccggacggacgtacggtaacgtaacgtttacttaccgtaagttaaacgaaaccgggttagtaaacggaacgttaacggggtaaacggttacggtttaaccgttacgggtttaaagggtttccggggttaaccgggttaccggggtaccggggtaacggtaacccggtaaggttaccggttacccgggtaacccggtttccggtaaccggtttacgggaacccggttccccgaaaccggggtcccctttccccgggtaacccggtttcccggg

SEQ ID NO: 202642 - DNA, 714 bp, Homo sapiens
  misc_feature: GYAE6OF02H0EAJ.21.46.E02.1.454.CMB.1.raw
  modified_base (136)..(136): a, c, t, g, unknown or other
  misc_feature (136)..(136): n is a, c, g, or t
  modified_base (235)..(235): a, c, t, g, unknown or other
  misc_feature (235)..(235): n is a, c, g, or t
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcanggctctgagcctcctatgagctgacacacgcccacccgtggtgtcagtcgtccccgaggacacggaccggccgaggactccactgtctcgtgactaggntaggactcgaccaaaagaatgagtacttagttacggtaccaagaacgaacgccgacggccgagtccccgtgttgttacganagtataataaacgacactaggagaccgccgtanagacgtacgcctagacgacgtattccgtcgttcggacctaccaccgtcgttaccggaacgggaccaggtaaccggcgttaacgtacggtttaccgaaacttaccgtaacgttaacggttaacggtaacggttacccggaaggttaccgaagggttaacgggacgtaacgggttccgttaagtaaccgttattacggtacgtaacctaaagtaaacgtaccgtaaagtacgttaaacggacgtaaccgtttagtacgggttaggggttagtaccggggtcgggaaccgaacggtaacgcggttaaccgacccggtaaccgttaggacgtacccgaccgttaacgggtcctccccgccccggttacg

SEQ ID NO: 202643 - DNA, 686 bp, Homo sapiens
  misc_feature: GYAE6OF02GFKYW.21.46.E02.1.454.CMB.1.raw
  modified_base (299)..(299): a, c, t, g, unknown or other
  misc_feature (299)..(299): n is a, c, g, or t
  modified_base (575)..(575): a, c, t, g, unknown or other
  misc_feature (575)..(575): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagtaaatatacgtcttattcggtaaccaaacagaacgccaacggccacggcccctggtgttagngtaataataagtaaacacactagaggacggccctacgacgagtactccgtagagcgtacttctcgtggtcctaccgagtcctacgaacggggtaccagaccagttaccgtacggttgtacttaacgtcaggtaggaacgtccggaggaccgtaaggaacgggtaacggacggtcgtacgaactttaacgttaccgttagtaacctaaaagtacgtaacggtacgtaaggtaaaggtacgtaacgttaccgtaggttacgggttacggttaccgggnggggaaccgggtaccgtaaacgggtcgttaaccggtacccggtttaccggtaaccggttccaacccgggtacccggaacggttaccccgttcccggaccccccgtttacgg

SEQ ID NO: 202644 - DNA, 861 bp, Homo sapiens
  misc_feature: GYAE6OF02HMX3T.21.46.E02.1.454.CMB.1.raw
  modified_base (188)..(188): a, c, t, g, unknown or other
  misc_feature (188)..(188): n is a, c, g, or t
tcagtcgtcgctcgcacgaccggtgctcgatttagactcatctacagggaaagggggtcgggtccaggaggcagaactctggggtgtctcgaccatggcctggatccctctacttctccccctcctcactctctgcacacggctctggacggccctcctaagtgagctgacacagccacccgtcggtntcagtccgtccccgaaggacacggaccggccaaggtactccaccttgactcgtagcagtgtaggacctacggaaccaaaaggtaattgtacggtactttagttaccggtaaccaaacgaacggaacgaccgaacggacccgaccggtaccccgttggttacgttaggttagtaataagtaaataaacgactacgtagacggaccgccctagagacgactccgtaggacgtaccgttacttccgtacgtccggtacctaccgacgtccgttacgggaacggaccctacggtactacggttaccgtacggttacgaacttaacgtacggtaacggtaacggtaacggtaccgaacggacggaaggggtaaccggtacgggacggttacgttaaccgttaacgtttacgttaaccgtacggtaaaaccgtaaacggtaacggaaacggttaaccgtaaagggttaaaccgggtaaccgtttaccgttaacggtttacggggttaccggggtttacgggtacccggggtaacggggtacccggtaaaacccgggttcggtaacccggttaccgggtttaaccccgggttaccggtttaaaccggaacccggttacccgggaaacccgggttacccggtaaccccgggttacccccgggtacccccgtttaacccggg

SEQ ID NO: 202645 - DNA, 647 bp, Homo sapiens
  misc_feature: GYAE6OF02GEO2X.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatatgcttattcggtaaccaacagaacgccaaggccacggcccctgtgttagtgatataagtaaacgacactagaagtacggccctacagacgtactccctaggacgtcgtaatttcctcgttaggccttcccgaacggtcgtaccggagggtacctacggcctaggtaccctacggtttacgaaccttacgtcgtaagtacggtaacggtccctaggacgtagggaacggacgtagggccttaggtacctaagttacgtacgtaaacaaacgagtaacgaagtagtaacggacgttaactaggtagtttcggggtgttcgggacgggtacgggtaaccgaacgtcggtacggaacccgttcgttaggaccgtacgaccgaacgggccttcccggtcccccgttaccgg

SEQ ID NO: 202646 - DNA, 731 bp, Homo sapiens
  misc_feature: GYAE6OF02FYN02.21.46.E02.1.454.CMB.1.raw
  modified_base (397)..(397): a, c, t, g, unknown or other
  misc_feature (397)..(397): n is a, c, g, or t
tcagtcgtcgctcgcacgaccggtgctcgatttagactcatctacagggaaagggggtgggtccaggaggcagaactctgggtgtctcaccatgcctggatccctctacttctcccctcctcactctctgcacaggctctgacggcctcctatgagctgacacacgccaccctcggtgcacgtcgtccccaggacacgacggccaggactcacctgcctctgcagatggactgaccaaaagaactatgactttagtacggtaaccaacgaagaacgcccaggaccaccggtcccctggtacgttaggacgtaagttaactaaattaaaacggactacgtaggaaacgaccggtcccctacgaagtacggtacttccccgtaggataccgtattccgntcgggaccttccgaacgtcgtaccgaggggtaacacggaccgtagtacccgtcgtttacggacttacgtacaacggtacgtaacggtaccgacgggacgaacggaacggtaacggacggaacgttacgttaacccttaagtttacccggtaacgttaaccgaaactaaggttaacgaacggttaaagtacggtaaacgggttaacctcggttaaacgggttcgggttacggttccgggaacgggtaacggaaccgttacggacggttacgacccggttaccggtaaggtccgaaccggtaacccggacggtacctcccggtacccgttacccgg

SEQ ID NO: 202647 - DNA, 936 bp, Homo sapiens
  misc_feature: GYAE6OF02HC9OU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtggtgtcagtcgtcccaggacagacgccaggatcactgctctgcagatggactgaccaaaagaaatgtgtacttattaggtaaccaaacagaaacgccgaggaccacggcccctggttacggttaagtagaagttaattaactaaaacggacctaacgtaggaacggaacgggccccctagaacgaagtaacgtacccccgtaggaacggtcggtaaactttcccgttacgtcgggtcccctaccgtaacggtaccttaccgggaaaggggtaaccgaaggtacccgtaaagggttacccttaaccgggttttacgaaaccgtttaaacgttacccggtaaaagggttaacggtaaaaccgggtttacccccgaaaggggtaccgaaaacgggggaaacggggtaaacccggggaaaccggggttaccggttaacccggttaaaaccgttttaaacggtttaaaccgtttacccgggttaaaacccgtaaaacggttaaaaccgggttaaacggtaaaccggttaaaacggggttaaacgggtaaacgggttttaaacccctttaagggttaaacggttttacggggggtttacgggtttaaccccgggggaggggtaaaaccgggggtaaacccgtaacgggttaacccggtaaccgggttaaccccggttaacccggttaacgggttacccgaaacccggtaaccccggggtaaaccggtacccggtttaccccgggtaccccccccgtttaacccgggg

SEQ ID NO: 202648 - DNA, 320 bp, Homo sapiens
  misc_feature: GYAE6OF02JKU2I.21.46.E02.1.454.CMB.1.raw
  modified_base (224)..(224): a, c, t, g, unknown or other
  misc_feature (224)..(224): n is a, c, g, or t
  modified_base (246)..(320): a, c, t, g, unknown or other
  misc_feature (246)..(320): n is a, c, g, or t
tcagtcgtcgctcgcacgaccggtgctcgatttagactcatctacaggggaaagggactggagtggttattattcctggggccagggaacccctggtaaccgtctcctcagcctccaccaagggcccatcggtcttccccctggcgccctgctccaggacgcacctccgagagcacagccggccctggctgcctggtacaaggcttactccctgtctctactgngcggctggcaaggcacaagtgnnnnnnnnnnnnnnnnnnnnnnnnnnnnnnnnnnnnnnnnnnnnnnnnnnnnnnnnnnnnnnnnnnnnnnnnnnn

SEQ ID NO: 202649 - DNA, 890 bp, Homo sapiens
  misc_feature: GYAE6OF02FZDHW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgcagatggactgaccaaaagtaactagtcgtactttagttcggtaaccaactaagaacgaccgtaaggcccgaacggtcccccgtggttacggttacggtagtaacttaagtaaagtaaacgacgaacgttaggaaggaccggtcccctagaaggtacgtactcccgtagacgtacgtacttcgtcgtcggccttaccgacgtccgtacggaacgggtaaccacggaccgtaacggtacccgtaacggtttacgttaacgtaaacgtaccggtaacggttaacggtaaacggttacccggaaacggggaacgtaacggggaaaccggggtaacccgggttaacgggtaaccgtaacggtttaaaccgttttaaccggtttaaaccgttaccggttaaaaccgtaaacgggttaaaccggttaaacggtaacccggtaaagggtttaacggggtaaccggttttaaccgttaaccggtttaagggtttttaaccgggggttacgggtttaccggggaccggggggttaaccgggtaaacccggtaacgggtttcccgggttaaaccggggttaccccggtttaaccgggttaaccgggttaacccgtaaccggggtaaccccggttaacgggtacccggtttcccccgggtaaccccccgggtttacccggg

SEQ ID NO: 202650 - DNA, 737 bp, Homo sapiens
  misc_feature: GYAE6OF02H5H5P.21.46.E02.1.454.CMB.1.raw
  modified_base (194)..(194): a, c, t, g, unknown or other
  misc_feature (194)..(194): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (382)..(382): a, c, t, g, unknown or other
  misc_feature (382)..(382): n is a, c, g, or t
  modified_base (518)..(518): a, c, t, g, unknown or other
  misc_feature (518)..(518): n is a, c, g, or t
tcagtcgtcgctcgcacgaccggtgctcgatttagactcatctacaggggaaagggggtgggtccagggaggcagaactcgtggggtgtctcaccatggcctggactccctctacttcctcccctctcactctctgcacgaggtctctgacggcctcctatggacgcagaaccacacgccctacccgtcgggtntacgaggttccgaccccgagggacacgggaccgggaccaggactccnccgtgctacgngacagtgtcggactacgaacaaaagtaatgtcgtatttagtaccggaaccaaagaggacgaccgacggccgtacggtccgttagttagtagtagtaatacttaagaaacgtcacgtgacgtaccgtccanaaggctactcgtgacgcttactcgtacgcggtactcgacgtacgtacggaagggcttaacgcgttaagtacggttacgggttaacacgttacgacgtaggaacggtaaccgtcggaagtacgggaaggcgggtacngggtacttacgagttactaacgtagtaaacgaaggaacggtaagaacggttcggaaggttaaccgtattaccgggttagggttcgggtaacgggttacccgggaagggtacccggttaagacccgggttacgacccggttaacccgggtaacggtacgggttacgaaaccccggtaccggtaacccgggtcccgttccccgggtaccccgtttaccggg

SEQ ID NO: 202651 - DNA, 804 bp, Homo sapiens
  misc_feature: GYAE6OF02H6OJ9.21.46.E02.1.454.CMB.1.raw
  modified_base (523)..(523): a, c, t, g, unknown or other
  misc_feature (523)..(523): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctagtgagctgacacacgacccaccctcggtgtcacggtcgtccccgaggaccgacgaccggccgaggactaccacccgttgctcctggacctagagtcgggaacctcggaaccgtaaaagaaatacgtggttactttagtttaccgggaacctaaacgacggaacggcccgaacgggaccccgaccgggttccccccgttggttaggtttaaggtagaactttaagttaaaacgttaaaacgaaccgtacggttacggacgggacccgtaccccgttacgaacggaacgtaccgttaccccgtgggaaccgtaccggtactttcccgttcggttccggacccttaccgacgtcctaacgggtacgggaaccncggtaccgtacgttaccgtacggtttacgtaaccggttatcgtaaggttagtaaccgttaccgagggtacaacgggagggaacggacggtactaggtaacttacgtttacgtaccacgtaaaagtgttaaacgacgtaggttaacggaacgttacttacgtgggttacgggtttaccgggcgggacgggtacgggtacggaacgtcccggttacggtacccggtttacgaccggttacgaccgggccgtaacggtcccgttacccccggaccggttcccgg

SEQ ID NO: 202652 - DNA, 723 bp, Homo sapiens
  misc_feature: GYAE6OF02IGR22.21.46.E02.1.454.CMB.1.raw
tcagtcgtcgctcgcacgaccggtgctcgatttagactcatctacagggaaagggggtgggtccaggaggcagaacctctgggtgtctcaccagtggcctggatccctctacttctccccctcctcactctctgcacaggctctgaggcctcctatgagctgacacagccaccctggtgtcagtgtccccaggacagaccggccaggatccacctgctctgccagatggactgaccaaaagaatatgaccttattggtaccaacagaacgccaggccaggcccctgtgttacgtgatatataaagtacactgagacggccctcgagagactcccctagacgcgtactttcctacgtcgggtcttccgaacgtcgtacgaggggaacctacggaccgtaggtacccgtacggtttcgaaccgttacgtacgaggttacggtaaacgttaccgaacgggacgaagggaacgggaacggacgggtaccgttagaaccgtttaagtttaacgtacgtaaccgaaacgtaacggtaacgaacgtaaggttaacggtaacggttaaccgtacgttaaacggtttcggggtttagggttcccggggtacggggtaccgggtaacccggtaacggtaccggttaccggtaacccggtttaacccgtaagggtaccgtaaccggtaccccggtaaccgggttacccgtcccgggttacccccgttacccggg

SEQ ID NO: 202653 - DNA, 742 bp, Homo sapiens
  misc_feature: GYAE6OF02F7Y0X.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttctccccctcctcactctctgcacaggctctgaggcctcctatgagtctacgacacacgccctacccgtcggtcgtcagtccgtacccgaggacgacgaccggccaggatccgtacctgctcgtcggacaggagtacggactacggaccaaaaggtaaatctagtactttaggtacggtaaaccaagtacgaacgccgacggtaccgaccggtcccgttgttacggttaaggtcgaattaagtaaacgtaaacgtactacgtaggaacggtaccggacccttgaacggactaccgtccgagacgtaccgtactttccgtacggtcgacccttacgaacggtccgtaaggaaccgggtacacggacgttaccggtactacggttacgtactagtacggtaagtacgtaacgtccgaggacgtaagggacggtacgcgtactcgttaacgttactacgtacgtaacgaacgttacggtacggtaacgagggttaacggtacgttaccgttaaggtaggtttaacggggttgacccgggggtaacgacggggaaccttcggtaccggtaccggtccggtacggttacggacccgtacgacccggttacgccggttacccggccccgtttacgg

SEQ ID NO: 202654 - DNA, 721 bp, Homo sapiens
  misc_feature: GYAE6OF02G3X2E.21.46.E02.1.454.CMB.1.raw
  modified_base (167)..(167): a, c, t, g, unknown or other
  misc_feature (167)..(167): n is a, c, g, or t
  modified_base (179)..(179): a, c, t, g, unknown or other
  misc_feature (179)..(179): n is a, c, g, or t
  modified_base (217)..(218): a, c, t, g, unknown or other
  misc_feature (217)..(218): n is a, c, g, or t
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
tcagtcgtcgctcgcacgaccggtgctcgatttagactcatctacagggaaagggggtgggtccaggaggcagaactctgggtgtctcaccatggcctggattccctctacttctccccctcctcactctctgcacaggctctgacggcctcctatgagctgacacngccaccctggtntcagtcgtcccaggacagacgcaggactcacgtgctcnncagntggactgacaaaagaantgcttattacgacaanagacgcagaccgcgccgtgtagtagntaatataataaagactacgtagacgcgcctanaggactaccgtacctaggacgcgtaactccgttacgtcgtacctccgtaacgcctacggtaacggacgacggtactacggtacgtacggttataacgtagtacgtaaggttacgtaaccggtcggaacggtacggaaagggaaccggggaacggtaaggtaccggtaagttaaaccttacgtttaacgttaaccggtaaacgaaacggtaacgtaaacggacgttaaacggtaacggtaacggttaccttagggttacgggttttacggggttcgggttaacccggggaggggttaaccgggaaccggtaaacggtacccggtacccggtaccgttttaaccgggacggttaacccggacccggtaaccggttaccccggtaccgttccccggtaccccggtacccgg

SEQ ID NO: 202655 - DNA, 927 bp, Homo sapiens
  misc_feature: GYAE6OF02HE5MP.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacggtcctcctatggagctgacacacgcccacccgtcggtgtcaggtcgtccccaggaccaggaccggccaggactccacctgcctctagcaaggagtagggacctaggaaccaaaagtaaatagtgtactttagttcggtaacctaacgaagaacgaccgacggcccgaccggtccccgtggttggttacgtagtattaataagtaaacgaccgtacgtacggaacggtacggaccctacgaagtacgtaccgttacccgtggacggtccggttaactttccgtcgtcggtaccctaccgtacgtacccgttacggaacggggtaacgtaaaccggccgtaacggttacccgttaacggggttaaccgtttacccgtaaaggtttacccggtaacgggttaaaggggtaaaccccgggttcccggtaaaggggtaacccgggtaaacggggaaaccgggggtaccgggggttaaccggttaaccggtttaccggttaaaccttttaaaggtttacccggtaacgttaaaacccgtaaacgtaaacggggttaacccggtaacgttaaagggtaacggggttaacgttttaaccgggtaccggttttaggggtttaaccgggggttcgggttaaccgggggtacggggaaaccgggtaacccggtaaagggttaccccggttaacggggtaccccggtttaccggtaaaccggttccggtaaacccggggtaaccccggtaaccgggttccccgttaccccgggtaccccccgtttaaccggg

SEQ ID NO: 202656 - DNA, 873 bp, Homo sapiens
  misc_feature: GYAE6OF02JYIBO.21.46.E02.1.454.CMB.1.raw
  modified_base (132)..(132): a, c, t, g, unknown or other
  misc_feature (132)..(132): n is a, c, g, or t
  modified_base (184)..(184): a, c, t, g, unknown or other
  misc_feature (184)..(184): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctcngcacaggctctgacggcctcctatgagctgacacacgcccacccgttcggtntcgacgtccgtccccaggaccacggaccggccgaggactaccaccgtgccttcgtcgtacaggtactacgggtactacggaaacccaaaagaaaacttaggttacgttaacctttaaggttaaccgggtaaaccaaacgaagggaaaccgaccggaaccgggacccgtaacccggtccccgtttaggttacgggtttaagtacggtaaattaaagtaaaacgtaaacgaacccgttaaggaggtaaccgggtaccggaacccgttacggaaacgacggtaacccttccggttaggacgtacggtaactttccgtcggtacggttacccaccgtacgacgttacggaaacggcgaacgtacgacgttacgtacgttacgtactaagtcggtaacggttacgaaccggtaccgtaaggacggaagggtacggaacggcggtacgttaacggtacttacgttaacgtacgtaaaccgaacggtaggttaaccggaaacggtttacggttaaacggttaacggtttacccgtaagggtttaccgggttagggggttaccgttaacgggggacccggggaagggttaacccggtaacgggtaccttacccggggtaaccgttaaccgggtacccgtaaccgggacccggttaacccggttaccggcccggttaccccgtccccgggttaacccg

SEQ ID NO: 202657 - DNA, 785 bp, Homo sapiens
  misc_feature: GYAE6OF02F8QXR.21.46.E02.1.454.CMB.1.raw
  modified_base (251)..(251): a, c, t, g, unknown or other
  misc_feature (251)..(251): n is a, c, g, or t
  modified_base (665)..(665): a, c, t, g, unknown or other
  misc_feature (665)..(665): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagttcgtcccccgaggacaggacggccaggatccaccgtgcctctgcagatggactgaccaaaagtaatntgtacttattcggtaccaagagaacgccaggccacggccctgtcgtagtgaatacataaacgacactaggacgtacggccctagagacgactcccgtagacgacgtactttacctcgtcgggtcctcccgtagtccgtaccggtacgggaactcggacctacgttacctacggttcgtaaccttacgtacggaacgtacggtaaccggtaccaacgggtacggaacggtacgggaaccggtaagggtaccttaggtaaccgtttaacggtttaacttaccggtaaactaaaaccggttaacgggtaacggtaacgttaacgggttaaccggttaacggttaaacccgtttacggttagggttttacggggttaccggggttacgggggtaccgggtaacccgggggttaaaccngggttaaccccggttaccgggtaacccccggtttaacgggtttaaccggtacccgggaacccggtaaacccgggttaacggggtccccggttacccggttaccccccccgggtacccggg

SEQ ID NO: 202658 - DNA, 700 bp, Homo sapiens
  misc_feature: GYAE6OF02JZYS3.21.46.E02.1.454.CMB.1.raw
  modified_base (251)..(251): a, c, t, g, unknown or other
  misc_feature (251)..(251): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccgaggacaggacggccaggatccactcgctcgtgacagagtggactcgaccaaaagaatntgtacttatcggtaccaacagaacgccaggaccacggcccctggtggttacgtgtataagtaagtaaacgacacgttaggacgtacggccctacgagacgactccctgacgtcgactttcctcgtcggccttaccgacgtcgtaccggaagggacctacggaccgtacgttaccgtaacggtttacgaaccgttactacggtaacggttaaggtaaccggttccggaacgtacggaaggtaacgggacgggacgtacgtacgaacgtttacttaacgttacgaactaaacgtagtaacgtaacgaacggtaagtaacggttaccgtgtaacggttgggttaacggggttacgcgggtaacggtaaccgtaacgggaccgttacgggtaccgttaccggtacgtacggtaccggaccgtaacgggcccttacccggtacccccgttacgg

SEQ ID NO: 202659 - DNA, 865 bp, Homo sapiens
  misc_feature: GYAE6OF02FTHPQ.21.46.E02.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccacccgtgggtctcagttcgtccccgaggacagacggccaggactcaccgtgcctcngacagactcggactcgaaccaaaagtaaatactgtactttaagttcggtaaccaactaacggaacgccgtaaggacccgaaccgggtccccctaggttcgtttaacggtaggtaacttaagttaaacgttaaaaaacgtaaccgtaaaccgttacgggaacgggtaaccggggtacccccgttaaccgaaacgggtaaacggttaaaccgttcccccgggtttaaacggaacggggttaccgttaaaccgttttaacccgttccgtttaacggggtcccgtttaacccgtacggtaaccgtttccgggaaacggggtaaccgtacgggtacccgtaacggttacctaaacggtttacggtaaccttaagttcgtaaacgtacggtaagtacccgtaaggacgtaagggaacggacggtaggtcctaggtaacttagttaaccgtaggtaacctaaaacgtaggtaacgtaaccgtaaggttaaggaacggtttacttaacggttacgtttacgggggttaggttaccggggacggtaacgggtaacccggaagtacggttaacccggtaccgttaccgtaacgggtcgttaaccggtaaccccgtaacgggcccgtaccccgggtcccccgttacccgg

SEQ ID NO: 202660 - DNA, 762 bp, Homo sapiens
  misc_feature: GYAE6OF02G8S1C.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtgtcagtcgtccccgaggacagaccggcaggactcacctgctctgcagtatcggactcgaaccaaaagtaaatactacgtactttagttacggtaaccaaacgacggaaacgccgacggacccgacggtccccgttagttcgttagtagtaataataaacgtaaagacctacgtacgaaggaccggccctacgaggacgtaccgtcccgtaggacggtacgttactttcctcgtcggtcctaccgtacgaccgttcggaacgggtaccacgggtctacggttaccgtaacggttacgtaccgttaacgtacgtaacgggttaacgtaaacggtaccggaaggtaccggaagggtaaccgggaacgggacggttactaacggttacttaacgttacgtacggtaaacccaaaggtaacggtaacgaacggtaaggtaacggtaacggtttacgttaacggttgggttttacggggtggttaccggggtaccggggacggtaacgacggttaccgcgggttacccgtacggtaacgggaccctaacggtcccgaacgggttcccgtcccggtaccccgttaccgg

SEQ ID NO: 202661 - DNA, 761 bp, Homo sapiens
  misc_feature: GYAE6OF02F5HM3.21.46.E02.1.454.CMB.1.raw
  modified_base (280)..(280): a, c, t, g, unknown or other
  misc_feature (280)..(280): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctggtgtcagtcgtccccaggacagacggccaggactcaccctgccgtctcgacgagatggacctcgaccaaaagtaaatatcgtctttaagttacggtaacccaaanaaggaacgccgaacggcccgaacggtcccctaggttcgttaggtagactaattaagtaaaacgtaactaaccgtaggaacggtacggccccttagaaggacgtaccgttccccgtaggaacggccgtaactttccgttcggtcggtcctaccggagtcctacggaacgggtaacacggtacgacgttctaacgttcgaacctaagtcgtaaacgttgggaaactaccggtaacgggtcgaaacgggacgggtaacccggtagggtaccgtaacgttaacgtttacttacgtacgtaaccgaaacgtaacggtaagacggtaacgtaaggtaaccgggttaacgtcttaaaggtttcgggggttagtaccggggtagggtaaccgggaacgtacgggtactttaccgggaccgttcccgttaagggtacccggtaccgtaccggtaaccggtcccgttaccccggtccccggtttaacccgg

SEQ ID NO: 202662 - DNA, 865 bp, Homo sapiens
  misc_feature: GYAE6OF02FQ3WF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacacgcccacccgtcggtgtcagtcgtaccccaggacaggaccggccaaggactcacctgctctgcagatggactgaccaaaaggtaaatatcgtactttagttacggtaacctaaacgaacgaaacggacccgaacgggaccccgtaaccgggtcccccccgttaggtttacgggtttaagtaggtaaacgtttaattaaaagtaaaaacggaactaaccgttagggtaaacgggacccgggtaccccgttaccgaaacggtaacgaaccgttacccccggtaggtaacggtaccgtaacgttttaccctcggttacgggtcccctacccgacggtaccgtacggtaacggggaacctacggaccgtaacgtaccgtaacggtttacgacttaacgtacgtaaggtacgtaacggtccgaagggaccgtaacgggaacgggacgggacggtacgttacggtaactttaacgtttacgtaacgtaaccgtaaaagtacggtaacggtaaaccgtaaggtaacggttaacgggttaccgttacgttaaagggtttcggggttacggtttaccggggacggggtaacgggaaccggtaaccgttaccggttacccgggttaacccggttaaccgtacggggttaaccgaacccggttaacccggaccggttacccggttacccggtccccccggttaacccggg

SEQ ID NO: 202663 - DNA, 729 bp, Homo sapiens
  misc_feature: GYAE6OF02G4QNC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgagctgacacagccacctcggtgtcagtcgtcccaggacagacggccaggatcacctgctctgcagatggactgaccaaaagtaaatatgactttagttcggtaaccaaacaagaacgccaaggccaacggccccttaggtacgttagtcgaattataataaacgtaacacgtacgaaggtacggaccccttagaagtacggacttacccgagacgtcgtaactttcccgtcgtacgcctacgtacgtacgtacggaacggacgtacgacgtacgttaccgtacggttactaacgtacgtacgtaggtaaacgtacggtaaccggacgacggtaacgggaacgggtacgaacggttacggttaacgttaaacgttaactaccggttaacgaaaccgtaaacgtaacggttaacgacggtaaacggttaacggtaacgtttaacgtaacggtttgggttacggggttcggaccggggttacgggaacggtaacgtaacggtaccgttacgggaacccgttacggtacgttaccgacggtaaccggtaacggcccgtaccccggttacccgtacggg

SEQ ID NO: 202664 - DNA, 678 bp, Homo sapiens
  misc_feature: GYAE6OF02J0AJK.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctactgcagatcggactcgaccaaagaatatgtcttagtacggtaaccaagagaacgcctacggccgtacggcccttgtacgttagtacgtataactacgtaaagcctaacgtgacgtacggcccctagaagacgtacctccgagacggtgtacttcgttacgtaccggtcctaccgaaggtccgtacggaaggggacctacggtcgtacgtaccgtacgttagactactaccgtaggtaacgacgtcacggacgtaaggacgacggagtctacggtaatacgttacagtaaccgtaaagacggtagaccgtagtacggtaacgtacgttacgtacggtttgggtaccgttaccgggacgggttacggaaaccgtggttaccgtaacgggtacccgttaaccggtacgggttaccgaaccggtcccgtaacgggtccgtaccccggttccccgttaacccggg

SEQ ID NO: 202665 - DNA, 715 bp, Homo sapiens
  misc_feature: GYAE6OF02JJCOV.21.46.E02.1.454.CMB.1.raw
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
tcagtcgtcgctcgcacgaccggtgctcgatttagactcatctacagggaaagggggtgggtccaggaggcagaactctgggtgtctcaccatggcccggatccctctacttctccccctcctcactctctgcacagctctgaggcctcctatgagctgacacagcccacccgtcggtgtcagtcgtcccccaggaccagaccggccaaggatccacctgctctagcgagagtcggactcgaccaaaagaatatgtacttagttacggtaaccaaactagaaccgacgacggtaccgaccggtccccttggttagttaacgtagtaattaacgtaaattaaacgacctaacgtaggtaacggtaaccgggcccttaacgaaggacgtaaccttccccgtaggaaccggtacgtactttaccgtcgtaccggtacctaccgagtacccgtacgagggacacgactaggtaccgtacgttanaccgtancgacgtagaacgtacgaggtcaaggacggacgaggtctacaacgttacttacacgtaaaccaaggacgttaacgacgtaagggtaacgtaaacggtaccttagtaacggtttgggttaacggtaccgggcgggtaacggtaaccggtaaggtccgttaacgtcccgggtaacttaacgggtaccgacggacccgtaacggtcccggtcccgaccccggttcgtacccg

SEQ ID NO: 202666 - DNA, 727 bp, Homo sapiens
  misc_feature: GYAE6OF02FIFL8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctgcagatggactgaccaaagaaatatgtactttattaggtaaccaacgagaacgccaggccgaggccccctggttagttagtagtatataagtaaagacactgacggacggtccctagagagtactacccgagacgtacgtactttcgtacgtcggtccttacccgacgtcgtacggaacggggaacgtacggacgtaacgttccgtaacggtttacgtaaaccgttacgtaccgtaaggtaacggtaaccggttacccgaacgggaccgtaaagggaacgggtaacgggacgggttaccgtacggtaacctttaagttaaccgttacgtaacaaaacgtagggtaacgtaacgtaagggtaaggtaacggttaacttacggttaggttttcgggggttaacggttcgggggacggtaacggggaaccgtaaggaccggtaccggtacccgttaccggtacggttacgaccgtacccggaacggtcccgtacccggccccgttaccgg

SEQ ID NO: 202667 - DNA, 689 bp, Homo sapiens
  misc_feature: GYAE6OF02G4J38.21.46.E02.1.454.CMB.1.raw
  modified_base (278)..(278): a, c, t, g, unknown or other
  misc_feature (278)..(278): n is a, c, g, or t
  modified_base (352)..(352): a, c, t, g, unknown or other
  misc_feature (352)..(352): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctggacggccttcctatgagctgaccacacgcccaccctcggtgtcaggtcgtccccaggacaggacggccaggactccactgctctgacagatcggactacgaccaaaagaatatgactttagtacggtaccaaanagaacgacacggccgacggtccctgtgttagagtaatataataaacgacacgtaggagaccgcctacgaagganacctcccgtagcgtacgtacgttctcggcgtcctccgactcgtacggacggacacgctacgtccgtacggttacgacgtaacgtcgaagtacggtaacgtaccgaagggacgaggaacggacggtaggcgtaacgtaacttacgttaacgtgtaaaccgtaacgtaaggttaacgaacgtaagtacggtaacgttacgtacggttagggttaccggggttagggttaccggggacgggtaacgggtaaccggtaaggtacccggtcggtaaccggttaccggttacggaccggaccggtaaccggaccgggtccctccccgggtacccttacccggg

SEQ ID NO: 202668 - DNA, 737 bp, Homo sapiens
  misc_feature: GYAE6OF02F7EAJ.21.46.E02.1.454.CMB.1.raw
  modified_base (185)..(185): a, c, t, g, unknown or other
  misc_feature (185)..(185): n is a, c, g, or t
tcagtcgtcgctcgcacgaccggtgctcgatttagactcatctacagggaaagggggtgggtccaggaggcagaactctgggtgtctcaccagtggcctggactccctctacttcctccccctcctcactctctgcacgaggctctggaggcctcctatgagctgacacacgcccaccgtcggtntcgagtcgtcccgaggacagaccggcaggactcactgctctcgcagatcggactagaaccaaaagtaacgttagttagttttacgttacgggtaacccaaacgaggaaaccgaccggaaggtacccgaaccggtccccgtaggttacggttaggtacgaattacttaaagtaaaacgacctaaccgtaggaacggaccgggtaccctacgaacggtaacggtaccttaccccgtaggacgtacggttaacctttctccgtacgggtccctaccgacgtacgttacggaacgggactacgacgtacgtacgtacggtttacgaacttagtacgtagttacggaacgtacgacgggtacaagggacggacgcggtacgtagtacttacgtactacgtaacaagtagaactagagtaacggtaagtaccttaggaggtttcggtacggtccgggtaacgggacgtacggtacggtaccggttaccggaccgttcggtaacgtaccgtacggacccggtaacgttcccgcccgggtttaccccgtgttaaccccgg

SEQ ID NO: 202669 - DNA, 769 bp, Homo sapiens
  misc_feature: GYAE6OF02H5YGZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacacgcccaccctcggtgtcagtcgtccccaggacaggacggccaggactcacctgctctgcagatggactgaaccaaaagaaatgtgtactttagttacggtaaccaaacgaagaacgccgaggacccgaacggtcccccgttggttagttaacgtgtaattaataaacttaaaacgacaacgtagaacggacggtaccctagagaacgtactcccgtagacgtacgtacttccgtacgtggaccttccgaacgtccgtacggacgggaaccacggccgtaacggttacgtaacgtttacgtaacgttaacgtaccgtaaagggttacggtaaaacggtccgaagggtaccggaaagggacgggtaacgggacgggtacgtttaaggtaaactttaacgtttaaacgtacggtaaaccgtaaaacggtaggtaaaccggtacgtaacgggttaacggtaacggttaccttaaggtacgggtttacggggttacggttaccgggacggggtaaccggtaaccgtacggtaccgttacgggaaccccgttacggtacggtaccgaccggtacccggtaacggtcccgtaccccggtccccgttacgg

SEQ ID NO: 202670 - DNA, 915 bp, Homo sapiens
  misc_feature: GYAE6OF02F8KXA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcacctctctgcacgaggctctgaggcctcctatgagctgacacagcccacccgtcggtgtcaggtcgtccccgaggacaggacggccaggatccacctgctctgcagatcggactgaccaaaagtaaactagtcgtactttagttacggtaacccaaacgtaggaaacgaccgacggacccgacggcccccgttaggttaggtttaacggtacgtaagttaattaataaaacggacgtaactaggaaggacgggtcccctagaaggacggtactaccccgtggacggtacggtaactttccgtcgtacgggtaccttaccgacggtcccttacgaacgggggaaccacggtaccgtacggtttaccgtaaccggtttacggtaactttaaccgtaccggttaacgggttaagggtaaacccggtttaccccggtaaacggggtacccgtaaagggggaaaccggggtaaacccgggtaaagggggttacccgttaacggtaaaaccgttttaaacctttaacccggtttaacggtaaaacccgtaaaaacggtaagggttaaaccggaaaccggttaaggttaaaccggggtaaacgggtttaacctaaccggttaagggtttacgggggttacggtttacccgggggacgggggaacggggtaaacccgtaaacggggttacccggttaaccgggtaaccccggtttaacccggttaagggtaccccggtaaccggtaacccccggtaaggggtccccgttaaccccgggtcccccccgtttaacccgggg

SEQ ID NO: 202671 - DNA, 861 bp, Homo sapiens
  misc_feature: GYAE6OF02I2FRD.21.46.E02.1.454.CMB.1.raw
tcagtcgtcgctcgcacgaccggtgctcgatttagactcatctacaggggaaagggggtgggtccaggaggcagaactctgggtgtctcaccatggcctggactccctctacttcctccccctcctcacctctctgcacgaggctctggacgccctcctatgatcctgaccacacgccctacccgttcggtgtccacggtccgtaccccgaggaccgacggaccggccgaggtactccaccgtgtcctcgtgacgaagtagtccggtactacggaacctaaaagtaacttcgtagtacgtttaggttacggaacccaacgaggaacgtacccggaacggtcccggaaccgtccccggttaggtttacggttacgtaacgtaagttaagttaaacggtaaaaccgacgacggttaggaaccgtaaccgggccccttagaacgacgtaccgttcccgtagggaaccgtcgtacgttccgtacggtcgtacccgtccgaaggccgtaaccgggtaacgggaccgtagtacccgttacggttccgtacggtttaaccgatttaaaccggccggtttaaggacggtaaccgtacggaacggtcgtaagggaacccgggagtaccggtacgttaaacggtacttaaccgttaacgtaccggaaacaaggtaacgtaaccggaagggttaccgaaaggttttaaggacccgttaagggttacggtttacggggttaccggtaccgggggacggtaccgggtaacgtaaccgggtcggtacccggtaaccccgtttacccgggttagtacccggaccgggtaaaccccgggtacggtttcccccgggttaacgtcccccggttaaccgg

SEQ ID NO: 202672 - DNA, 825 bp, Homo sapiens
  misc_feature: GYAE6OF02IR2X2.21.46.E02.1.454.CMB.1.raw
tcagtcgtcgctcgcacgaccggtgctcgatttagactcatctacagggaaagggggtcgggtccaggaggcagaactctgggtgtctcgaccatggcctggatccctctacttctcccctctcactctctcgcacagactctgaggcctcctactgacgctggaaccactacgcccacccgtcgggtagtacgacggttcgtacccccgaggaccgacggacccggggaccgaagggtacttaccaacccgttggtccttcgttacggacgaacgtaagttcggtaccttacggaaacctaaaaggtaaattcgtacgtacgttttagtacgggttaaccaaacgacggtaacgtaccgacggaccgtcggtaccccgtgttacggtttagacggtaattaacgtaaagttaaaacggactaacgtaggaacggacggtacccctagtacggaaccgtccttacccggtagtaaccggtctaccgtttaccgttcgtccggtacctaccggtacgtccggtaccggaacgggaccgtaacgaccggtaacggtacctacggttactaacgtacgtacgaacgtacggtaacgtcgaacgggacgaagggtacgggacggacgtacgttacgtaacttaccgttaacgacgtaaccgaaacgtacggtaaccgaacgtaaagtacggtaacgttaacgttcgtaacggttcgggttcgggtaaccgggacggttaacggaccggaacggttaccgtccgtaaccggttcgtaacggtaccgaccggtaaaccgggttacacccgggtttcccgacccgtaaccgg

SEQ ID NO: 202673 - DNA, 730 bp, Homo sapiens
  misc_feature: GYAE6OF02IH7AX.21.46.E02.1.454.CMB.1.raw
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (306)..(306): a, c, t, g, unknown or other
  misc_feature (306)..(306): n is a, c, g, or t
  modified_base (319)..(319): a, c, t, g, unknown or other
  misc_feature (319)..(319): n is a, c, g, or t
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacagcccaccctcggtgtcagtcgtccccaggacaggaccggccaggactccacctcgntcctgcagatggactcgacaaagaatngtacttagttacggtaaccaacgagaacgaccacggccacggcccctgtacgttagtanataataagtaaanacgtaacgtgagacgtccctagaganacttcccgagacgtcgtattcgtctcggtcctaccncgtactcggaacgggacacgactacgttacgtacgtttcgaacgttactaacgtaggtaagtaaccgtcggaaacggtacggaacgggtaacggacggaacggttcgtaacggttaactttaaccgttacggttaacgtaaaaccctaacggtaaacgtttaacggaccgtaaaggttaaaccgggtagtttaacccgttacggttaaacgggtttcggggttacggttaccgggggtacggaccggggtaacctacgggtaccgtaacccggtacccgggttaaccgtacgggaccgtaccgggtaaccccggtaaggttcccgttcccccggtacccggttacccgg

SEQ ID NO: 202674 - DNA, 653 bp, Homo sapiens
  misc_feature: GYAE6OF02IMGPW.21.46.E02.1.454.CMB.1.raw
  modified_base (317)..(317): a, c, t, g, unknown or other
  misc_feature (317)..(317): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctcctatgagctgacacagccaccctcggtgtcagtcgtccccaggacagaccggcaggatcacctgctctgacagatggactgaccaaaagaatatgtcttattggtaccaacagaagccaggccaggtcccctgtcgttagtgatatataaagacactgagcggcccttnagagtactccctgacgcgtactttctctggcctaccgagcctacgacggggactaggctacgtacgtacggtttcgaacttagtaccgtaaggtacggtaaacgttcccgaaggacgtaaggaacgggacgaggtccgtagaacgttaacttacgtacggtaacctaaagaggttaacgacgaaggttaagtaacggtacttaccggtaggtttacggggttacggttaccggggacgggtaacgggtccgtaaacgggtccgttacggtacccggttaccgtaggttaccgtaacggcccggtaacggccttccgggtaaccccccgtttccggg

SEQ ID NO: 202675 - DNA, 733 bp, Homo sapiens
  misc_feature: GYAE6OF02JRX31.21.46.E02.1.454.CMB.1.raw
  modified_base (256)..(256): a, c, t, g, unknown or other
  misc_feature (256)..(256): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacgcctcctatgagctgacacacgccacccgtcggtgtcagtcgtccccgaggacacggaccggccaggatccaccgttgctctgcagactcgggactgaccgaaagaacttntacgtcttacgttaggtaccaacgaagacgaccgacggaccgaccggtacccttggttacgttagtacgtaataactaactaaacgacctacgtagaacggaccggtacccacgtaacgacggtaccttacccgtagaccgtacgtacgttcctagcggttaacctcgacgtcgtacggaacggactacgacgtacgtacgtaccgttagactacgtacgtagtaacggtacgcggtacggacgaaggacggacggacgtacgtaggttaacttaccggtataccgtaacgtaaacctagggtaacctaacgggtcgtaaacggttacggttaacttacgttcggggttaacgggttccggttaacggggacgggttacgaaccggtagtaccggtttacccgggtaacgttcccggttaacggtacccgtacggacccggttaacggccccgttaccggtcccccgttaacccggg

SEQ ID NO: 202676 - DNA, 913 bp, Homo sapiens
  misc_feature: GYAE6OF02ICF90.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctagtgagctgaccacacgcccacccgtcggtgtcgacggtcgtacccccgaaggaccgacgggaccgggcccgaagggtaactcccgtaacccgtcggtccttccgtcggaccgtaaggtaaggtacgggtaaccgtacggaaaacccaaaaaagggtaaacttagttacggttaccgttttaacggtttacccgggtaaaacctaaaaccggtaaacggaacggacccgaaccggacccgtaacccggtccccgttgggttacgtttacggtagtaacttaaattaaacgtaaaacggtaaccgtaacggttacggaaacggtcccggtaaccccttaggaaacggtaacgtaacccttcccgagggtaccgtacgttaactttcccgtcggtaccggtaccttaccgtgtacccggtacggaacgggtaaccgacgtaccgtacggtaccgtacggtttaactaacgttacgtacgggtaaacgtaccggtaaacggttaccgggaaggaaccgggttaacgggaacggggtaaaccggtggttaaacccgtagttaacgtttaaccgttaacggtaagtaaacccgtttaaaaggacggtaaaccgttaacggtaaacgggttacggttaaccggttaaccgtttggtaagggttcggggttaggtaccgggacggtacggacgtacggtaccgtcggtaacccggtacgtacggccgtaacccggcggtaccggcccgttcccggaccgttcccgg

SEQ ID NO: 202677 - DNA, 802 bp, Homo sapiens
  misc_feature: GYAE6OF02IT04J.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgagctgacacacgcccacccgtcggtgtcagtcgtcccgaggacacggacggccaggactccaccgtgtctcgtgcagtacgtggactacgaaccgaaaagtaattacgtcgtactttacgtttacggtaaaccaaacgtaacgaaacggtacccgacgggtacccgaccgggtccccccgttaggttacggtttaacttagggtaactttaaatttaaagtaaaacggtaacctaaccgtaggaaacggtaccggtaccccgttacggaacggaacgttacctacccgtacggaacggtaccgttacgtttaccgttccggtcggtccgtaccgtacggtccgttaacggacgggacgaacggtaccggtacggtacgttaaggttacgtaacttaacgtacggtaacgttacggaacggtcggtaacggacggaacgggtaacgggaacggacgggtacgttacgttaacgttaacgtttaacggtacgtaaaccgtaaacgttaacggtaacgtaacgtaacggtaaggtacggttacttacggtaggtttcgggtacggttcggggacggtacgggtacgtacgtcgtaccggtcgttacggtacgtcgacgtaccggacgtaccgtccggtacccgtccgg

SEQ ID NO: 202678 - DNA, 741 bp, Homo sapiens
  misc_feature: GYAE6OF02JFVXT.21.46.E02.1.454.CMB.1.raw
  modified_base (183)..(183): a, c, t, g, unknown or other
  misc_feature (183)..(183): n is a, c, g, or t
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagcctgacacacgcccacccgtcggtntcagtcgtccccaggacagacggccagactccacctgcctctgcagatggactgaaccaaagaaatntcgtacttagttcggtaaaccaacgaacgaacgccgacggccgaccggtcccgttggttacgttagtgtaacttaacgtaaataaaacgcctaacgtaggacggtaaccgggtcccctacgaaggtaactaccgtccccgtaggacgtacgttaactttccgtcggtacggtcctaccgtaacgtccggtaacggaaccgggaactacggtacctaaggtttaccgtaacggttacgtacctaacgttacgaaggttaccgtaaaccggtccgaacggttacggaacgggaacgggtaccggtaacggttcctttaacggacctttaaaccggtttcgtaacgtaacggaaactacggggtacaacggttaggacgtaacggttactaccggtaggttcgggttacgggtcggacggtacggaaacgtccgtacgtaccggtccgtacgtccggtacgaccgtccggaacgcccgtacccggtcccgtacg

SEQ ID NO: 202679 - DNA, 714 bp, Homo sapiens
  misc_feature: GYAE6OF02FLJPX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggacctgaccaaaagaaattactgtcttagttacggttaacccaaacgaacggaaacgcccgaacggccccaacggtccccccttggttaggttacgtacgattattaactaaaaggtacaccgttaggtaacggacggtccccctagtaacgacgtaacttccccgtaggacgtaccggtatttccgtacgtggcctaccacgtcctacgtaacgggaccagtcccgtacgtccgtaacgttcgacttataccgtaggttacgaacggtaccgaagggaaccgtaggaacgggtacgggacgtacgtacgtaaccttaagtttaccgtagtaacgtaaacgagtaacgacgtaagtacggtaaggttacttagtacggtttgggtacggttacgggacgggtaacggtaccgtaacgtccggttacgacccgttacggtacggttaccacggtaccccgaaggcccgttcccggtaccccgttaccgg

SEQ ID NO: 202680 - DNA, 870 bp, Homo sapiens
  misc_feature: GYAE6OF02HA0Z6.21.46.E02.1.454.CMB.1.raw
  modified_base (183)..(183): a, c, t, g, unknown or other
  misc_feature (183)..(183): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctcgtggacgcctcctatgagctagacacacgcccacccgtcggtntcagtccgtccccgaggacaggaccggccaaggtctccaccgttgccttcgtcgacagtagtcggactacgaaacctaaaagaattacgtacgtacttttaacgttaaccggtaaaccaaacgaacggaaccgtacccgacgggtaccccgaccggttccccgttaggttacggttaggtagtaagtaattaaacgtaaacgaccgtacggttaggaccggtaaccggtcccgtaagacgggtaacgtacccgttacccggtaacgggtacgtaccgtttactttccgtacgggttccggttccctaaccggtacgttacccggtaacggtaaccggggtaccgacgtaaccggttaccggttaccgtttaacggttacgtaacgttaccctagggttaaacggtaccggttaaacacccgggtaagaccggaaacgggggaacggtacccggacgggttctaacggttactttaagttaaccgttacgtaacctaacgtaacggttaacaacggtaagggtaccggttaacgtttaccgtggtttaacgggttcgggtacgggttaccggggaggggtaaccgtacggtacgggtacccggtccgggtaacccggttcggttaaccggttaaccgacccggggttaccgaccgggttcccccggtacccggttacccggtacccgg

SEQ ID NO: 202681 - DNA, 678 bp, Homo sapiens
  misc_feature: GYAE6OF02FNMVO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtgtcagtcgtaccccaggacaggacggccaggctcacctgctctgcagatggactgaccaaaagaattatcgtctttagttacggtaaccaacgaagaacgccgaggtaccaccggtcccctggttggttacgtagtaatataagtaacgactacgtaggaacggtacggcccctacgacgtacgaccttcccgtaggacgtaccgtacttccgtcgttcggtaccgtccgacgtctacggaacggtacgacgcgtacgtaccgtacgttagaccttagtcgtaaggttaggtaacgtcgaacgggtacgtaaggacgggacggtacggtactacggtaacttacgttacgtacgtaacgaaacgtgtacgacgtaaggtacgtacgtaccgttgtaggttcgggttaggtccggaggggtaacgtacggaacggtcgtaccggtaccgtacggttaaccggtccgaccggtaccgacgggtccgtacccgtcccgtaccgg

SEQ ID NO: 202682 - DNA, 782 bp, Homo sapiens
  misc_feature: GYAE6OF02FL5CW.21.46.E02.1.454.CMB.1.raw
  modified_base (275)..(275): a, c, t, g, unknown or other
  misc_feature (275)..(275): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacgaggctctgacggcctcctatgagctgacacacgcccacccgtcggtgtcaggtccgtccccgaggaccaggaccggccgaagggactccgaacctgccttctgcgagtacgtgggactacgaaccgtaaaagtaaattntcggtacttaagttacggttaaccaagaacgaacgccgacggaccgacggtcccgtggttcgttagtacgattaataagaaacgactacgtagacggacgcctacgagacgacgtccgtagacgtctacgttcgtacgtcgtaccgtaccgtacgtccgtacggaacgggtaccacgacggtacggttaccgtacgttacggtaacttacgtacgtagttacggtaaccgtaccggaacgggacggtaagggaacgggacgggtaacggtcctaacggttaacggttaactttaacgtaacgtaaccggtaaacgttaacggaacgtaacgtaaagggttacggtaacggttaacggttaaccgttgggtttaccgggttagggtttaccgggggacgggtaaccgggtaaccgtacggtaaccgggttacccggttaacccggttccggtaaccggttcggacccggtacccggaacggtcccggtacccggttccccgtaaccgg

SEQ ID NO: 202683 - DNA, 723 bp, Homo sapiens
  misc_feature: GYAE6OF02GRC1Z.21.46.E02.1.454.CMB.1.raw
  modified_base (253)..(253): a, c, t, g, unknown or other
  misc_feature (253)..(253): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacacgccacccgtggtgtcaggtcgtccccagggacagaccggccgaggactcacctgcctcgtgcagagtggactacgaccaaaagtaatntcgtactttagttcggtaaccaacgtagaacgccgaggaccacggccccgttggtacggttagtaggtaactaagttaataaacgaccgagtacggaggaccggccctagaaggacgtaccttcccggtagacgtacgtacttcgtcgtcggcctacgacgcgtacgacgggaccaggaccgtacgtacctacggttacgaacttacgacgtaacggtacggtaaccgttacggaaggtaccgaacgggacgggtaccggacggtactaacggtacttaacgttacgtagtaaccgaaacgtagtaacgacgaacggttaacgacgttacgttacgtagggtttcgggtacggttaccggggacgggtaacggaaccgtaacggtaccggttacccggtaaccggttaccggttacggtaacccgaccggtaacccggtacggccccgttcccggcccccggttaaccgg

SEQ ID NO: 202684 - DNA, 685 bp, Homo sapiens
  misc_feature: GYAE6OF02GSYQG.21.46.E02.1.454.CMB.1.raw
  modified_base (243)..(243): a, c, t, g, unknown or other
  misc_feature (243)..(243): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (285)..(285): a, c, t, g, unknown or other
  misc_feature (285)..(285): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctctatgagctgacacacgcccaccctggtgtcagtcgtaccccaggacagaccggcaggactcacctgctctgcagatggactgaccaaaagaatntgcttataggtaccaanagaancagccacgccctgtgtacgngtaataagtaataaagctacgtagaagacggcctagaagaagtactcccgtaggacgtacgtaacttccgtacgtacggccttaccgacgtaccgtacggaacggtaacgagaccgtaacgtccgtaacggttacaactaacgtacgtaagtacgaacgtacccgaaggcgtaaggaacgggtacgaggtcctaaggtaacgttaactacgtagtaaccgaaaacgtaggtaacgtaaccgtaagtaacggtaacgttaccgttaacgtagggtttcggggtaaccggttaccgggacggggtaaacggtaccgtaacgggttaccgtaacggtacccgtaacggttacgaccgtaccggacccgttaaagggcccgttaccccggtccccgttaaccgg

SEQ ID NO: 202685 - DNA, 759 bp, Homo sapiens
  misc_feature: GYAE6OF02HT98I.21.46.E02.1.454.CMB.1.raw
  modified_base (209)..(209): a, c, t, g, unknown or other
  misc_feature (209)..(209): n is a, c, g, or t
  modified_base (347)..(347): a, c, t, g, unknown or other
  misc_feature (347)..(347): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggntccacctgctctgcagatggactcgaccaaaagaatatcgtacttagttacggtaaccaacaagaacgaccacggccacggtcccctaggtgttacgtagtaactaattaataaagactactagacgacggtccctanagagtactccgtagacgcgtaactttcctacgtcggtacctaccgacgtcgtacggaacgggacacgaccgacggttacgtaccggttagtaaccgtactacggtaaggtacgaacggtaccgaagggacgtaacgggaacgggtacggaaggtcgttagtaaccgtttaagttaccgtaacggtaacctaaaacggtaagtaaccggtaacgtaagggttaacggtaacggtttaccttacggttaaggttttacgggggttacgggttaccgggggtaacgggggaaccgggtaaccggaacgggttaccggttaccgggtaaccccggttaaccggtacgggtaccggtaaccgggaccccggttaaccggggtcccgttacccccgggtacccccggttaaccccggg

SEQ ID NO: 202686 - DNA, 690 bp, Homo sapiens
  misc_feature: GYAE6OF02FUOP5.21.46.E02.1.454.CMB.1.raw
  modified_base (210)..(210): a, c, t, g, unknown or other
  misc_feature (210)..(210): n is a, c, g, or t
  modified_base (381)..(381): a, c, t, g, unknown or other
  misc_feature (381)..(381): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagaccggccaggacncacctgctctgcagatggactgaccaaaagaattatgctttattcggtaaccaacgaagaacgccaggcccacggtcccctggttgttagtagaactaataagtaaagacacgtagagacgccctacagagactccctgacgtcgtacttcgtacgtcggtcctaccgacnccgtacgaacgggtacacggactaggtcctacggtgtaactacgtactaaggtacgaagttccgacggtacgaacggcggaacggacggtcgtacggtaacttacgttacgtcgtaaccgaaacgtaaggtaaccgagtaacggtaacggtaacgtttaaccgtacgttaagggtttcggggttacgggttccgggacggggtacgggtaaacccggtaaggtaccggttacggtaaccccgggttaccgtacgggtaccgtacggtaaccccggaacgggtcccgtaccccggtccccggttacccgg

SEQ ID NO: 202687 - DNA, 794 bp, Homo sapiens
  misc_feature: GYAE6OF02GS11L.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctcccctctcactctctgcacaggctctgacggcctcctatgagctgacacgacgccaccgtcggtgtcgtacgtcgtcccaggacacggaccggccgaggactcgaccgtgcctctgacgtacgagtcgggactacgaaccaaaagtaattacgtcgttacgttaagttaccggtaaaccaagtaacggaaccgtaccggaacggcccggtaaaccggtccccgttaggttacgtttaacggtacgtaaacgtttaaacgtaaaaggttaaaaccgtaccgtaacggttacggtaaacggtacccggtaccccgtaagtaacggtaacgtaacccgttcccgtaaggtaccggttaccgttaacgtttccgttaccggtccggttacctaccggacgttccgtacggacgggtacacggtacgtacgtcgtaacgtcgtacttacgtagtacggtacgtacgtacgagacggaggtacggagtacgtcgtaacgtagtttacctacgtacgtaactaacggtacgtacgaacgtaggtaacgtagtttacgtacggttaggttcgggtccgggttaacggaccgggtaacgtaccggtaacggtccggttaaccggtaccggtttacgaccggtacgtaacccggcggtaaccggtcccggtttacccgccccggttaacgg

SEQ ID NO: 202688 - DNA, 788 bp, Homo sapiens
  misc_feature: GYAE6OF02F89YM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacctcggtgtcagtcgtccccaggacagacggccaggactccacctgctctgcagatggactcgaccaaagaatatggtcttagttggtaaccaacagacgcacggccacggcccctgtagttagtgatataagtaaagacgactggacgtacggcccttgaagagtactccccgtgacgacggttaacttccgtacgtcgggtcccttaccgagtccttacggaaccgggtacctaacgggccttaaggttacctaaccgggttttacgaactttaacgtaccggtaagggtaccgttaaaaccgggttacccgaaccggggtacgtaacggggtaaacggggaacccgggttaacgggggccttttaaacggggtaaccctttaaacggtttaaccgggtttaccgtttaaaacccggaaaaacggtttacggttaaaccggttaaacgtacgggttaaacggtaccgggttacttaccggtaaggttttacggggttcgttaccgggacgggtacggaaaccgtaccgggttaacctcgggtaaccccgttcggtaacggttaccggaccggtaccccgggtaagcccggtttaccccggtcccgtttaacccggg

SEQ ID NO: 202689 - DNA, 843 bp, Homo sapiens
  misc_feature: GYAE6OF02FPUKO.21.46.E02.1.454.CMB.1.raw
  modified_base (554)..(554): a, c, t, g, unknown or other
  misc_feature (554)..(554): n is a, c, g, or t
tcagtcgtcgctcgcacgaccggtgctcgatttagactcatctacagggaaagggggtgggtccaggaggcagaactctgggtgtctcaccatggcctgggatccctctacttctccccctcctcacttcgtctgcacaggctcctggagcctctatgagctgacacgacgcccacccgttcggtgtccgaggttccggtacccccgaagggtaccacggaaccggcccaagggtacctaccgtaacccgttggacctttccgcggacgtaaggtagtacgggaccttgaaacccgtaaaaagaaaatgtcgtacttttaacgttacggtaaacccgaaacaacggaaacggacccgaacggtcccgaaccggtcccccgttggtttaggttacgtagtaattaagtaagtaaaacgacctacgtaggaacggaccggtacccgtagaacggacgttacgtcccgtaggaacgtcgtacttcctacgtcggtccctacgacggtacgtacgaagggaacacgtaccgtagttaccgacggttacacgtttaacngtaaggttacgaacgttaccggaggacgacgggaacggaccggtaggtaccgtacgtaacgttaacgttaccgtacggtaaacctaaacggacgttaacggaagttaacgtaagggtaacccgttacgttaacggttagggtttacgggttacgggttaccggggtacggggaaacgggttacgtacggttaccgggtaccggttaccccgttaccggttacgggttaacccacccgggtaaacccggtaccggtttccccggtaccccggttaccccggtttacccgg

SEQ ID NO: 202690 - DNA, 1131 bp, Homo sapiens
  misc_feature: GYAE6OF02JNTDH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactttctgcacagtctctgaggcctcctatggagctgacacacgcccaccctcggtgtcagtcgtccccgaggacaacggccaggatcacctgctcgtggagagtgctattacggaaccctaaaaaatttgtttaggttttttaccggaaccgacgtaccgaaggtaaacggttacgacggtaccgtaaccgggtcccccttaggttacggtttacgggtcctaacgtacccgtagttacggaacgggtaaccgaggtaccggaacccggtaccccggttacccgggacctccccggttacggtaacggtaggtaccgttttccgtaccggttacggtacccgttaccgtaaaccgttcggaaccgggggtaccgggtacggtacccgttacggttacggtaccgtttaccggtacgggttaaccggggttcggggtaccccggttagggggttacgggtaaacgggtaaccggttacgggtaacgggttacccgtacggtaaacccgtttaacgttaaccgtttaccgggtttaaccgtaccggttaaccggtaacggtaaaccggtaaccgtaaccgggtaccgggttacgggttaacccgggttcccgttaaccgggttaaaccggggtaacggggggttaccccggttttaacggggttaaccccggggggggtaacccgggggttaaaccgggggttaaacccccggggtttacgggttaaaccccgggggtttaaccccggggtttttaaccccccggggttaaccggggtaccccgggtaaccccggggttaaccccccgggggttaaaccgggttacccccgggggtttaccccccccgggtttaaccccccggggttaccccccgggggtttttaacccccgggttaaccccccgggttttaacccccgggggtttttaccccccccggggttttaaccccccccccggtttacccccccccgggttttaccccccggggttttaacccccccccggg

SEQ ID NO: 202691 - DNA, 771 bp, Homo sapiens
  misc_feature: GYAE6OF02HE2V3.21.46.E02.1.454.CMB.1.raw
  modified_base (167)..(167): a, c, t, g, unknown or other
  misc_feature (167)..(167): n is a, c, g, or t
  modified_base (285)..(285): a, c, t, g, unknown or other
  misc_feature (285)..(285): n is a, c, g, or t
  modified_base (422)..(422): a, c, t, g, unknown or other
  misc_feature (422)..(422): n is a, c, g, or t
  modified_base (487)..(487): a, c, t, g, unknown or other
  misc_feature (487)..(487): n is a, c, g, or t
tcagtcgtcgctcgcacgaccggtgctcgatttagactcatctacagggaaagggggtgggtccaggaggcagaactctgggtgtctcaccatggcctggactccctctacttctcccctctcactctctgcacagactctgacgcctcctagtgagctgacacgancccacccctcggtgtaccaggttcgaccccgaagggacacggaccggaccgaaggtcctaccaccgttgccttcgtagacctaggacgttagggactacggaaccaaaaggtaaaatntcggttacttaagttacggaaccaaagaacgacgaccacggaccgccgtaccccgtagtagttagtaccgtattaagtaaactaaacgaacgtactaggaacgaccgtacccgttagaaggtaccgaccgttaccgnggaacgtcgtacttttctccggtcgtccctacgtaacggtccgtacgggaacgggtaacgtaccncggtaaccggtacgttacggttaacggactaacgtacggtaacgttacgaacggttaccgaaggaccggaaggtaaccggaggttaacggacgttacgtaccgttaagttacccgtagtaaccgtaaacgacggtaacgaacgaagggtagtacgttacgtaacggttacgttagggtttccggaggggtacggaacggtaacccggaacggtactaccgggttacggtaccttagggacgttaccggaccggaccggttaccggtacccgcccgttaccccgg

SEQ ID NO: 202692 - DNA, 799 bp, Homo sapiens
  misc_feature: GYAE6OF02GXBT5.21.46.E02.1.454.CMB.1.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
tcagtcgtcgctcgcacgaccggtgctcgatttagactcatctacagggaaagggggtgggtccaggaggcagaactctgggtgtctcgaccatggcctggatccctctacttcctccccctcctcactctctgcacaggctctagaggcctcctagtgagctgacacagcccaccctggtctcagtcgtccccaggacagacggccaggancacctgactcgtgcagataggactacgaccaaagaaatntagtacttagttacggtaaccaacgaagtaacgtaccgaacggacccgaaccggtaccccccttggttacggttaaggtaggaacgttaacgtaaacgttaaaacggtacccgaacgttacggaacgtaccgggaccccttacgaaggtagtaccgtcccccgtaggtacgacggttacgttcgttacgtcggtcctaccgtagccgttacggacgggaactacgcgtacgttaccgtaacggttacgtaaccgttacgtacgtaacgttacggtaacgttacgaacggacgtaacgggaacggacggtacgggtacgtaccgtaagttaaacgttacttaacggtaacctaaaacggttacgtaacgtaacgttaaacggtagtaaccgttacttacccggttaaggtttaccggggttaacgggttccggggttaacgggaccgggtaaccgtacgggttacgtaccccgggtaaccgtttaccggtaaccggttaacgtacccggtacccgagggtcccccgtccggtaccccccggtttaccgg

SEQ ID NO: 202693 - DNA, 648 bp, Homo sapiens
  misc_feature: GYAE6OF02I5VWW.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctctgacagtatggactcgaccaaaagaatatacgtacttatacggtaaccaaacagaacgccaggccaacggtcccctagtcgttagtagtataataataaagacacgtagagacggtccctagaagagtactctctagacgcgtaacttcctacgtcggtcctacgacgcgttacgaacggggtaaccaggtacctaggtacccgtagttacgtaactacgtacgtagtagaacgtcgaggtacgaggacgggaacgtacggcttagaaccgttattaacgtacgtaaacgaaacgtagtaacgtaactaaggttacgtaacgttactacgtaagtttacggggttaggtacgggacggtacggtaaccgagtacgtcggtacccgtaggtaccgacgaccggaccgtaacggtccgtacccggtccccg

SEQ ID NO: 202694 - DNA, 690 bp, Homo sapiens
  misc_feature: GYAE6OF02IT8G6.21.46.E02.1.454.CMB.1.raw
  modified_base (404)..(404): a, c, t, g, unknown or other
  misc_feature (404)..(404): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagccaccctcggtgtcagtcgtccccaggacagacggccaggatccacctgcctctgacagatgggactgaccaaaagaaatatgtactttatttagggtaaccctaaacaggaaacgccgaaggcccaacggtccccctgttgttagtgataataataaagaccactagagacggccctacgaagagtactcccgtagacgcggtaactttctccgtcggctccgagtctcgaggacngacaggtccacgttgactagtacgagtagtaacgtccgaggtcaaggacggaacgggtcggactagggtaaccttaagtttaaccgtacggtttaaaccaaaacggtacgtaacgtaaccgtagggttaaaggtacgggttaacctttagtacgggttttacggggtaggtttaccggggacgggtaacggggtaccgaaacggtttaccgacgggtaaccccgttacgtacgggtaccgtaccggtaacccgacgggtacccgttcccggacccccggttaccgg

SEQ ID NO: 202695 - DNA, 530 bp, Homo sapiens
  misc_feature: GYAE6OF02FKA5Z.21.46.E02.1.454.CMB.1.raw
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgcagatggactgaccaaagaaatatgcttattggtaccaacagaagccaggccacggcccctgtgttagtgatatataaagacactgagacggcccnaganactcccgtgagtgactttctctcggcctccagctcgagggacngcagtccacgttacgactanctagtagaacgtccgaggtcgaggaggacgaggctagtactatacgtgtacaacgagtagacagtagtagtactcagttgggcgttgggacggagggaccaggctacggaccgtcgtaggacacggccgaggcctcgccccgtacgg

SEQ ID NO: 202696 - DNA, 820 bp, Homo sapiens
  misc_feature: GYAE6OF02IDOS8.21.46.E02.1.454.CMB.1.raw
  modified_base (152)..(152): a, c, t, g, unknown or other
  misc_feature (152)..(152): n is a, c, g, or t
  modified_base (181)..(181): a, c, t, g, unknown or other
  misc_feature (181)..(181): n is a, c, g, or t
tcagtcgtcgctcgcacgaccggtgctcgatttagactcatctacagggaaagggggtggtccaggaggcagaactctgggtgtctcaccatggcctggatccctctacttcctcccctcctcactctctgcacaggctctgacgcctctangagctagacacacgccctacccgttggtntcgagtccgtacccgaggacgacggtaccggacgaaggactaccacgtcgtcctcgtacgacgaagtacgtacggtaaccacgtaaacaaaaagtaattgtacgttactttaagttaccggaaacctaaacgaagaaccggaccgtaccggacccgtaaccggttcccccgttaggttacggttaacgttacgaatttaaagtaaaacgtaaaacgtaacctacgtaggaaccggtaccggtaccccgtaagaacggaacgttaccgtccccgtagggaccgtacgtacctttaccgcgtcgggtacctaccgtaacgtccgtaacggaacgggaaccacgtaaccggtacgtaacgttacgtaaccggtaactaacgtacggtaacgttaacgtaaccggtacggtaacggaacgggtaggtaacgggaacgtacggttacgttaacgtaacgttaacttacgtaacgtaaaccgaagttaacggtaagtaacgggtaagtacggtaacgtttactagggttaggtcgggttacggtacggaccgggaacgtaccgtaggtaccggttacggtacccgttaacgtccgggtaaccgtaccgtaccggtacggtcccgtaccccggtaccgttacccgg

SEQ ID NO: 202697 - DNA, 872 bp, Homo sapiens
  misc_feature: GYAE6OF02IJEIM.21.46.E02.1.454.CMB.1.raw
  modified_base (180)..(180): a, c, t, g, unknown or other
  misc_feature (180)..(180): n is a, c, g, or t
tcagtcgtcgctcgcacgaccggtgctcgatttagactcatctacagggaaagggggtggtccaggaggcagaactctgggtgtctcaccatggcctggatccctctacttctccccctctcactctctgcacaggctctgacggcctcctatgagctgacacacgcccacccgttggtntcagtccgtccccaaggacacggaccggccaggactccaccgtgtctcgtgaccgagtacgtgggtaacctcgaaacccgaaaaagttaacttgttcgtaacgttttagtttaaccgggaaccaaaacgtaacggaaccgtacccgtaaccgggaccccgtaacccggtccccccgtttaggtttaacggttacggtagtaagtttaaacgttaaaacgttaaaaccgaccgtaacgtaggaacgtaccggtaccccctaggaacgtacgtaaccctacccgttaggacgtaccggttatttacccgtcgttaccggtacccgttcccgaacgttcccggtaacgggaaccggggtaacgtaaccgtacggtaaccggttaccgttacgttaagtaaccgttgtaacgagtacggtaccacggtaggacgaacgggacggtaacggtacggtacgtacgtacttaacgtttacgtacgaaacgtaaacgttaacgtaacggtagtaacggtaaacggtaacgttaaccgttagggtttaagttcgggggtttaccgtaccggggtaccgggaaaccggtaccggttaaccgtaccggttaccgggttaaccccggttaacggtaaccggttccggaacccgggtaccccgtaaacgggttcccccgttacccggttaccccccggttaccgg

SEQ ID NO: 202698 - DNA, 783 bp, Homo sapiens
  misc_feature: GYAE6OF02GQSG2.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctactctcccctcctcactctctgcacaggctctgaggcctctatgagctgacacagcccaccgtcggtgtacagtctccccaggtaccaggtaccggaccagggactccgaccgtcgacttcgtcgcgtacggacgttacggaccttaggaacccaaaaagtaaaacgttacgtcgtacttttaacggtttacggtaacccttaaaacggaacgtaaacggaccccaacgggtccccgtaacgggtcccccccttaggtttcgggtttaaacggttcggtaaacgttaacgttaaacgtaaaacggtaacccgtaacggttacggaaacgggtacccggtacccttacggaacggtacgttaacctcccgttaagacgtaccgtacgtttacctccgtacggtcctaccgtacgacgtacgacgggtacgacgcgtaaagtcccgtaaacgttccgaacgttacgtacgtaacgtcgtaaaccggtcgtaacgaccgttaaggacggacgtacggacctgtaagttacgttacgtacgtacaacgtacgtacgtacgtagttagtacggttaccgtgtagttcgggtaaggttcgacgggtacggtaacgtacggtcctacgggtccgtaacgtccggtacgacggaccgtacggtaccgtcccggtaccctaccgg

SEQ ID NO: 202699 - DNA, 652 bp, Homo sapiens
  misc_feature: GYAE6OF02GEL1N.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatccacctgctctggagtatttcattgaccaaaaagtatatacttgttggttccagcagaagtcaggccacggcccctgtactggtcactccagtgacggccgagtacgacgacaccgtcccgggactcccgtgagtacgtacttcctcgtcgtccctccacgtcctacgagggacgtaggtccggaccctaccttagaccttacgtcgacgggtcggggacccgtagggtacggacggagtaggaacgccgtacgtacttaacgttacgttacgtttaccgaccgtaaccgagaacgtagtagtacggtacgtagtcggtaggggttacgtcgggacggtaaggaccgtaggttcgtacccggttcgttcggtaccgacggtacccgaacggtcccgtcccgtaccccgttcggtaccacccgttccgttcccgttccccccg

SEQ ID NO: 202700 - DNA, 674 bp, Homo sapiens
  misc_feature: GYAE6OF02HXKH1.21.46.E02.1.454.CMB.1.raw
  modified_base (250)..(250): a, c, t, g, unknown or other
  misc_feature (250)..(250): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacacgcccacccgtcggtgtcagtcgtccccaggacaggaccggccaggactcacctgctcgtgcagagtggactgaccaaaagaaatntagtacttagttacggtaaccaacaagaacgccgaggccacggccctgtgttagtagtatagtaactaaagactaacgtggaagaccggccctagaagagtacctcccgagacgacgtacttctaccgtcggtacctccgagcgtacggacggacgtacggacgtacgttacgacgtttagaaccgtatacgtaaggttacgaacggtcgaagggtcaagggtacggaacggtacggtctacgtaacgttacgttaacgtgtaaaccgaaagttacgtaacggacgtaaggttaacggtacggtaccttaggtagttggggttacgttcgggacgggtacggtaaccgagggtccgtaaccggtacccgttccggaacgttcgaccggtacccgtaacgggcccttacccggccccggttaccg

SEQ ID NO: 202701 - DNA, 722 bp, Homo sapiens
  misc_feature: GYAE6OF02GDI0C.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccgaggacaggaccggccaggactcacctgcctctgcagatcggactgaccaaaagaatatgtactttagttcggtaaccaacgaagaacgccgaacggaccacggccccttggttaggtttagtacgaattaacttaataaaacgtacaacgtaggaacggacggtccctacgaagacgtactccccgtagacgtcggtaacttcgtcgtacggtcctaccgacgtaccgtacgacggggacacgtaccgtacgtaccgtacgttacgtaaccttagtacgtaacggtacggtaacgtaccggaaggacgtaagggaacgggacggaggttctacggtacttacgttactacgtaacgtaaacgtaggtaacgtacgtaaggttaggtaacggttacttacgtagggtttcgggttcgggttaccggagggggaaccggtacggaacggttcggtaccgggtaaccggttacggttacggtaccggaaccggaccggtaacggtccccggttacccgccccggttaacccgg

SEQ ID NO: 202702 - DNA, 849 bp, Homo sapiens
  misc_feature: GYAE6OF02FZOVI.21.46.E02.1.454.CMB.1.raw
tcagtcgtcgctcgcacgaccggtgctcgatttagactcatctacagggaaagggggtgggtccaggaggcagaactctggggtgtctccaccatcggcctggactccctctacttcctccccctcctcactctctcgacacgacggtctcgtggacggtccttacctagtggacgctacgaacacgacgcccctacccggtcggtgtacgacgttccgtaccccgaggacgacggaccgccgaaggtctccaccgtgcctactcggacagtagtacgggacttacgaaaccgtaaaaagtaaacttacgtcggttactttagttaccggaaaccaacgaagaaccgaccggacggccgtaccggtcccttggttaggttacgtagtaactaagtaaacgtaaacgactacgtaggacggtaccgtaccctagagtaccgtaccgtccggtagacgtacgttactttccgtcgtcggtacctaccgtcgtaccggtacggacgggactacgtacgaccggttcgtaacgttacgtactacgtacgtaacggtaacgttaccgtacggaacgggtacgggaaacggtaacggggtaacggacgggttaccgtaaaggttaacctttaacgttaacggtaaccgtaaaccggtaaaacgttacggtaaacggtaacggtttaaggtaaacgggtaacgtttaacccttagggttaacgggttttcggggttaccgggtacggggtacggtaacgggtaaaccgtcggtaccggttaaccggtacccggttcggttaaaccgccggaaccggtaaacgtccccgggtaccgttccccggaccgtttacccgg

SEQ ID NO: 202703 - DNA, 903 bp, Homo sapiens
  misc_feature: GYAE6OF02JBBUH.21.46.E02.1.454.CMB.1.raw
  modified_base (268)..(268): a, c, t, g, unknown or other
  misc_feature (268)..(268): n is a, c, g, or t
tcagtcgtcgctcgcacgaccggtgctcgatttagactcatctacaggaaaggggtggtccgaggaggcagaactctgggtcgtctcgaccatggcctcggatccctctacttctccccctcctccactctctgcacaggcctctgacggcccttccgtaatgagctgacacacgccaccctcggtgtccacgtcgtccccaggacctagaccggccgaaggactccacctgcctcgtgcgagactcggactcgaccgaaagaaactntcggactttacgttcggtaaccaaacgagaaacgccgtaacggaccccgtaacggtcccccgttaggttacggtttaacggtacggtaacttaacgttaaacgtaaaaacgtaccgtaacgttacggaacgggaaccggttacccccgtacgtaaacggtaaccggtaaccgtttacccccggtaggtaaccggtaccggttaaacgtttcccgttaccgttcgggtaccctttacccgacggtaccgttaccggtaacggggacaaacggtcgtaaccgttccgtacgtttaccgtaaccgttactaccgtaacggtacgtaaacggtacccgtaacggaccgtaacggtaacggggaaccggtacgggtacgttacggtaaccgtttacgtttaaccggtttacgttaaccgtaaaccgtaacggttaacgtaaccgtaaacggttaaggtaaccggttaaccgttacggtttaaacggtttacggggtttaccgttaaccgggggtacgggtaaccggggtaacccggtaaacgggtccggtaaccgggttaaccccggttaccggttaacggtacccggtaaccgggtaccccggtaacggtccccggtaccggtccccccggttaaccgg

SEQ ID NO: 202704 - DNA, 965 bp, Homo sapiens
  misc_feature: GYAE6OF02FKCW6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctcctatgagctgacacagccacctcggtgtcagtcgtccccaggacagaccggcgaggactcacctgcctctgcagagtcggactggaccaaaagtaaacttagtggtactttaagttcggtaacctaaacgaacggaaacggacccgaagggccctaaacgggcccccgttaggttaccggttttaaggtacggtaacttaaacgttaaacgtaaaaacggtaacccgtaacgtacgggaacggtaaccgggtacccccgttacgaaacgggtaaccggtaaccgttccccccggttaagggaaccggtaccggttaactttaccggttccgtcggggtacccttacccggaccggtaccgttaccgggaaacgggggaaccgtaaccggtacccgtaaacggtttaccccgtaacggttttaacggaacccgtttaacgttaccggaacgggtttaacggtaaacccgggttacccgaaacggggtaaccgtaagggggaaacggggaaccggagggttacccggtaaacggttaaccgtttaacgtttaaccgttacggtaaaccggtaaaacgttaacggtaaacgggttaaccgtaaagggttaacggtaacgggtttaaccgttaaccggttaaagggtttttaccgggggttacggttttaacccgggggggtaaccgggggtaacggggtaaacccggtaaaacgggtcccgttaacccgggtaaaccccgggttccggtaaccgggttaacccgacggtaaccccggtaagggtcccccgttacccgggttaccccccggttaacccgg

SEQ ID NO: 202705 - DNA, 701 bp, Homo sapiens
  misc_feature: GYAE6OF02I8FHV.21.46.E02.1.454.CMB.1.raw
  modified_base (157)..(157): a, c, t, g, unknown or other
  misc_feature (157)..(157): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctctatgnctgacacacgcccaccctcggtgtcacgtcgtcccagacagaccgcaggactcaccgtgctctgcagtagtggactggaacctaaaaagaaattagtagtactttaagttacggtaaaccaaacgtaagaaaccgaccgacgggacccaccgggcccctttagttacggttaagtagtaaattaacgttaaaagaaaaccgtaacgtaacgtacggaacggaaccggtccctaacgaagaaggtacctacccgtaggacgtaccgtactttccgtaccgtcggtccttacgaggccgtacgaacgggtacagtacctacgtcgaacgttagtactacgagtaaggactaacgtcgaaggtacgaaggagaccggagactagtaactacttaagacgtaacaaagttaacgaatacgtagaggtaacgtacgtctaggttagggttacgacgggtacgaacggaaccggtaggaacccggtctaaccggttaccgaaggttacccacggaacccgtaagtccccggttaccgccccggttaaccg

SEQ ID NO: 202706 - DNA, 811 bp, Homo sapiens
  misc_feature: GYAE6OF02FX2EI.21.46.E02.1.454.CMB.1.raw
  modified_base (231)..(231): a, c, t, g, unknown or other
  misc_feature (231)..(231): n is a, c, g, or t
  modified_base (258)..(258): a, c, t, g, unknown or other
  misc_feature (258)..(258): n is a, c, g, or t
  modified_base (478)..(478): a, c, t, g, unknown or other
  misc_feature (478)..(478): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacagcccacccgtcggtgtcagttcgtccccgaggaccagacggccaggactcacctgcctctgacgagngtgacctacgaacctaaaagtaaattntacgttactttaacgttacggtaaaccaaacggaagaaaccgaccgtaacgggaccccaaccgggtcccccgtttaggttacggtttaaggtagtaattagtaaataaaacgtaaccacgttaggaacggtacgtccccgtaagacgtaacgtacctaccgtagaaccgtcgttaactttccgtacggtcgtcctaccgagtccgtacggaagggtaccncgtaccggtacgtacgtaacggttacgtaacttaacgtaccggtagtaaaccggtacggtaccgaacgggacggtaacgggaagggaccggtaacggtacggtaacgtaactttacgttaacgttacgtaaacctaaacgtaacgtaacggttaacgtaaagggttaacgtaacgttaacgttaacggttaggtttcgggtacggggtttaccggacggggttaaccgtaaccggtaacggtacggttaacccgggtacccgttaaccggtaccggtaaccgtaaccggtacccggtaaccggtccccggttcccggtaccccggttacccgg

SEQ ID NO: 202707 - DNA, 713 bp, Homo sapiens
  misc_feature: GYAE6OF02GROW6.21.46.E02.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggactcactgctcgtgcagntaggactgaccaaaagaatatcgactttagttacggtaaccaaacaaggaacgccgacggaccgaccggtcccccttggttaggttaggtagtaagttaataagtaaaacgtacaacgtaggaacgggtaccggcccctacgaacggaacgtaccttcccgtacgaggtaccgttacttccgttcgtggtccctacgtacgtcctacgggacgggaacgacggacgtacgttaccgtacgttacgtactacgtacgacggttaacggtacgtaccgaggacgaagggacggacgacggtatacgtaacgttacgttacgtacgtaaccgtaaacgtaaggtaacgtaacggtagttaacggtacgttaacgttcggtaggtttacggggtggttacggggacgggacggtaaccgaaggtaccgtacggtacccgtacggtacgtacgaccggtaccgtacggtcccgtcccggtccccgttaccgg

SEQ ID NO: 202708 - DNA, 742 bp, Homo sapiens
  misc_feature: GYAE6OF02JW3AH.21.46.E02.1.454.CMB.1.raw
  modified_base (278)..(278): a, c, t, g, unknown or other
  misc_feature (278)..(278): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgaccacagcccaccctcggtgtcagtcgtccccgaggacaggaccgcaggactcacctgctcgtcgcacgatcggtacacgaccaaaagtaaatactagtcttagttacggtaaccaanacgaacgccgacggtacccgacggtccctggttaggttacgtagattaacaaagttaaacgactacgtagaggaaccggtccctacgacggaatacctcccgtaggcgtacgtacgtttcacgttacggcctaacctcggactacgggacgtaacgaacgcgtacgtccgttaccggttagtaccgttagtacgtaacggtaacgtaacggtaccgaagggacgtaacgggtacgggaacgacggttacgacgttaacgttaaacttaagttacctaaacggaaaccgttaaggaacgttaacgaaggttaaccggtacggttaacgtaaccgtttaagggtcggggtaacgggttccgggtaacgggtacgggtaacccgaaggtaccggtaaccggtaccgttacggtaccggtacgtaccgggaccgtaacggtcccggtacccgtccccggttaacccgg

SEQ ID NO: 202709 - DNA, 588 bp, Homo sapiens
  misc_feature: GYAE6OF02GOJX0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccctcggtgtcagtgtccccaggacagacggccaggatcacctgctctgcagatggactgaccaaagaatatgtacttagttaggtaaccaacaaggaacgccacggccgacggtcccccttggtgttacgtgataatataaagacactggagacgcctgagagactccgagagacgtacttcgtcgtcggcctaccgagtctcgagggtacaggcacgtactagttacgacttatcgagtagaacgtccgaggacagggaggacggaggtctacgtactattacgtataacaaacgtggtaagacgaagtaggtacgttacgtattacggttgggtcgtacgggagggacggtacggaaggtcgtacggtaccgtaccgtaggacctcggacccgtagcccgtccgccccgtacgg

SEQ ID NO: 202710 - DNA, 847 bp, Homo sapiens
  misc_feature: GYAE6OF02FQPLZ.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccacccgtcggtgtcagtctccccgaggacaggacggccaggatcaccgtcgcctcgtgacagagtggactcgaccaaaagtaaatatgtactttagttcggtaaccgtaaacgaagtaacgaccgtacggacccgtacggccccccgttggttcggttaggtacgtaattaacgttaaagtaaaagtacgaaccgtaggaacggtaccggcccgttaacgaacggaacgtaaccttcccgtaggaacggtaccgtactttaccgttacgttcgggtaccttaccgacggttcgtaccggaacgggtaaccgacggtacacggttaccgtacgtttacggaaccttacgtacgtaaggtcggtaacggtaccgaacgggacggaaaggtacgggaaccggtacggtacgttaacggtaaccttaaggttaaccgtaacggttaaccgaaaaccggtaagggtaaacgttaacggtaacgtttaaagggtaccggtttaacgttaccgggttaagggttttccggggttaacggggtttaccgggggtacgggggttaaacccggggtaacggtaaccgggtaccggttaacccggttaaccggttaccggttacggtaccgggttaaccggaaccccgggtaacgggtccccggttaccccggtcccccggttaccggg

SEQ ID NO: 202711 - DNA, 775 bp, Homo sapiens
  misc_feature: GYAE6OF02JNRGM.21.46.E02.1.454.CMB.1.raw
  modified_base (113)..(113): a, c, t, g, unknown or other
  misc_feature (113)..(113): n is a, c, g, or t
tcagtcgtcgctcgcacgaccggtgctcgatttagactcatctacagggaaaggggtgggtccaggaggcagaactctgggtgtctcaccatggcctggatccctctacttcncccctcctcactctctgcacaggctctagaggcctcctatgagctgacacacgcccacctcggtgtcaggtcgtaccccaggacagaccggccaggtactccacctgcctcgtgaccagacgtcggacctacgaaccgaaaagtaactactcggtacttagttacggaaaccaacgaacgaacgaccgacggaccgaccggtaccccgtaggttacgttaacgtacgtaagttaacgttaacgtaaaacgactaaccgaggtaacggaccggtccctaacgaacgtacgtaccgtacccgtagaacgtccggtacttacgtcgtacgccgtaccgagtccgtacggtacgacgtacgactacgtacgtacgttacgacttacgtacgtacgtacgaccgtcgtaacggacgaagggtacgtacgggacgttactaacggtaacttaacgttcgtacctaaacgtaaacgtaccgtaagtaaccgtaaggttaacggtacgtttacggtacctttaaacgggttcggggttaacgttaccgggggtaccgtaaacgggttaccggtaaacggtccgttaacgggttaaccccggtacgtttaaaccggaccgtacccggttaaccgtaaccggtcccgttaccccggtcccgtttaacccggg

SEQ ID NO: 202712 - DNA, 730 bp, Homo sapiens
  misc_feature: GYAE6OF02J192X.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctctgacggcctcctatgagctgacacacgcccacccgttcggtgtcagtccgtaccccaggaccacggaccggaccaggactcaccgtgcctctgactagacgtcggactacgaaccaaaagtaaatctgtacttacgttacggtaaccaaacgaacggaacggaccgaccggacccgaccggtccccgttggttacggttaacgtagtaagtaataaagtaaaacgactacgtaggaacggtaccgtaccctacgaaggtacgtaaccgttcccgaggacgtacggtactttcctcggtcggtacctaccgcgtacgtacggaacgggactacggcgtacgtcgtacgttagtactacgcgtacgtagaccgtcggaacgacgacgggtacggacggtacggtacttacggtaacgttacgttacgttacggaacgtaaacgttaggtaacgtacggttaaggtaaccgttacggttacttacggttggttggtacgggttcgggacggtacgtaaccggtcgtacgtaccggtcgttaaccgtaggacccgacggtaccggacgttcccgtacccggtccgttaccg

SEQ ID NO: 202713 - DNA, 831 bp, Homo sapiens
  misc_feature: GYAE6OF02I8RBR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacacgccaccctcggtgtcagtcgtccccgaggacaggaccgccaggactcaccgtgcttcgtgcagtagtcggactacgaaccaaaagaattgtcgtacttaagttacggtaaccaacgtaacggaacgaccgaacgggacccgacggtccccttggtacggttaggtacgtaaattaacgtaaagtaaaaaccgacgtaacgtaggaacggtaccggtaccccttaacgaaggaacgtaccgtccccgtaggacgtaccgtagtttaccgtcgtcggtacctaccgcgtacgtaaccggacggacgtacgcgttacggtaccttacggttacacgttactacggtaacggtaacggtaacgttcccggaaagaccggaaagggtaaccgggtaacggtacggtaaccgtttacgttaaacgttaaccgtttaacgtacggtaaaacctaaacgggttaacgtaaccgtaacggtaacggttaaaggtaaccgggtttaaccttaacgggttaacgggtttaacggggttccggggtttaccggggaccgggtaaacggtacggtaaaaccggttccggttacgggtaaaccccgttaccgggtaacggtacccggtaaccgggacccggttaaccgggcccggtttaccccggtcccccgttaacggg

SEQ ID NO: 202714 - DNA, 540 bp, Homo sapiens
  misc_feature: GYAE6OF02GSE8I.21.46.E02.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgcagatggactgaccaaagaaatatgtacttattggtaccaacagaagccaggccacggcccctgtgttagtgtatataataaagacactagagaggccctnagagactcccgtgagcgattctctgctcagctcaggacagcagtccagttagactatcagtagacgtaccgaggcagacggacggaggtacgtagacttagttactgtacaaacgtagtagacgtagtaagtagtactatagtttgggtagttcggacggtaggaccgaagccgtacgaccgtcgtacggcacggacccgaggccgtccgccccgtacgg

SEQ ID NO: 202715 - DNA, 840 bp, Homo sapiens
  misc_feature: GYAE6OF02HY87U.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctcccctcctcactctctgcacaggctctgacggcctcctatgagctgacacacgccacccgtcggtgtcagtcgtcccgaggacaggacggccaggactccacctgctcgtgcagagtcggactcggaacaaaagtaacttataggtactttaagttacggtaaccaaacacgaacgaccgacggaccgacgggtccccttggttaggtttagtagtaattaacgtaaacgtaaaacgaacaacgttacggaacggtaccgggtacccctaacggtaacggtacgtaaccgttacccggtacgaacgggttaccgttacgtttacccgttccggttacggtccctaccggtaacgtacccggtaccgggaacggggtaaccgtacggtacccggttaaggttacccggtttaacgggtttaccgttaacgttacgttaacggttacgggttaacgtaaccggtacggtagggtaccgaaaggggaccggggaacggtaacgggtcgttaacggttaactttaacggtttaacgtacgtaaaccggtaaagttaacggtaacggaaagtaacggggttaactaccgggtttacgttgttaacgggttcgggttaacgggtccgggtaacggggacggtaaccgtaacggtaccggttaaccgttcccggttaaccgggtacgtacggaacccggaccgtaacccgggtccctacccggtccccgtacgg

SEQ ID NO: 202716 - DNA, 977 bp, Homo sapiens
  misc_feature: GYAE6OF02JPTXX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacagccaccctcggtgtcagtcgtccccaggacaggacggccaggatcacctgctcgtggacgatcgctagttacgaacctaaaaaagtttacgttcggttttttacggaacccagacgtaacggtaaacgttacgaacgggacccgtaacggtcccccgttaggttcggtttacgggtaccctaacgttaccctaaggttacggaacgggaaccggtaacgggaaccggtaacccggtaacccccgttacccggggaaccttaccccgtagggtaacggtaacggtacgtttcccgttcgtacgggtacccttaacccgtaaacgttaccgggaacgggggtaacgggttaccgggtacccgttaacgggtttacgtaaccgtttaccgtaccgggtaacgggggtacccgggggtaccccggttaaggggggtaccggggtaaggtaacgggttaacggtaaacgggtccgttaacggtaaaccgtttaccgttaaaccggttttaccgggttaaccgttaccggtaaacggtacccgtaaacggtacccggtaaaggtccggttaaacggggtttacccggtaacgttaacccgggttaccgggggacggggggttaaacctttacggggttacccggggtaacggggtaaacgggtaaccccgggttaagggtttacccgggtacccgttaaccggttacgggtaccgttaaaccggacccgggtaaacgtccccgggttacccgtaaccccccgggttacgtacccggttacccctttaccgggttccccttacccccggttccccccg

SEQ ID NO: 202717 - DNA, 795 bp, Homo sapiens
  misc_feature: GYAE6OF02G6V88.21.46.E02.1.454.CMB.1.raw
  modified_base (179)..(179): a, c, t, g, unknown or other
  misc_feature (179)..(179): n is a, c, g, or t
  modified_base (256)..(256): a, c, t, g, unknown or other
  misc_feature (256)..(256): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacagccaccctcggtntcagtcgtccccaggacacgaccggccaggtactccgacctgcctctgcagagtcggactgaaccaaaagtaaactntgtactttagttacggtaaccaacgaaggaacgccgacggaccaaccgggtcccccgttaggttgttaacgtaggtaacttaagttaaacgttaaaaaggaaccaacgttacgggaacggaaccgggttaccccctagaacggaacgtaaccttccccgtaggaacgtacgtaactttccgtccgtaggtcccttacgacgtccgtacggaacggggtaaccgacggtccgtacggtacgtaaccgggtttacaaccgtttaactccgtaacgggttacgtaacggtacccgtagggaccgtaaggaacgggtacggacggtactacggtaacttaacgtttaacgtacgtacgtaaaacgaggtaacgacgtaaggtagtaacgtaccgttacggttacggttgggtttaccggtacggggacggtaaccgggtaaccggtaacggtacccgttacgggtaacccgttaccggttaaccggtacccggtaacggaccccggtacgggtaccccggttccccggtaccccgttaccggg

SEQ ID NO: 202718 - DNA, 635 bp, Homo sapiens
  misc_feature: GYAE6OF02IX5A8.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacgtgctctgcagatggactcgaaccaaaagaaatgtgtactttagttacggtaaccaacgaagaaacgccacggcccacgggccccttggttgttacgtagattaataataaagacactggacgacggccctgagagtactcccgtgacgtcgtattccgtcgtcggcctacgacgtctacggaggaccagaccgtacgtaccgtacgttagtaccgttagtacgtacggtacgtaacggtaccgtagggacgtagggaaggacggacggtactaggtacttacgtactagtaactaaagaggtaacgaagtaggtaagcgttactggtacgttgggtcgtcgggacgggacggtaccgtaaggcgtcggtaccgttcggtacgacgtaccggaccggaacggtcccgtcccgccccggttaccg

SEQ ID NO: 202719 - DNA, 960 bp, Homo sapiens
  misc_feature: GYAE6OF02HPXZ3.21.46.E02.1.454.CMB.1.raw
  modified_base (166)..(166): a, c, t, g, unknown or other
  misc_feature (166)..(166): n is a, c, g, or t
  modified_base (180)..(180): a, c, t, g, unknown or other
  misc_feature (180)..(180): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgaccacngcccacccgtcggngtcagtcgtccccaggacaggaccggccaggactccacctgctctgcagngnggactgaccaaagaatntgtacttagttacggtaaccaacgagaacgccaggtcccgaacggcccctggttacgttagtagaagttaataaagttaaaacgactaacgttaggaggaccgggtaccctacgaacgacgtaccgttaccccgtacggaacggtcgttaactttcccgtacgttccgggtacccgttacccgaacgtccgttacccggaaacggggtaacccgtaagggaccccgtaaagggtttacccgtacccgggttttaaacgtaaacccggtttaacgttacccgggtaaacgggtttaacgtaaaaccgggtttacccggaaacggggtaaccccgaaaggggtaaacggggaacccgggttaacgggtaacccggtttaacggttaaacccgttttaaagttttaacccgttaaccgggttaaaaccgttaaaacccgggtaaagtttaaacccgggtaaaaccgttaaaggggttaaacggggttaaccggtttaaacccggtttacggtttaaacgggttttccggggtttaacgggttaccggggggacccgggggttaaccgggggtaaaccccggtaaagggtacccccggtttaaaccgggtaacccggtttaaccccgggtttcgggtaaaccccggtaacccggtaacccccggtaaacggggtttcccccgtccccggttaaccccccccgggtttacccgggg

SEQ ID NO: 202720 - DNA, 722 bp, Homo sapiens
  misc_feature: GYAE6OF02JB11O.21.46.E02.1.454.CMB.1.raw
  modified_base (221)..(221): a, c, t, g, unknown or other
  misc_feature (221)..(221): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccaggacagacggccaggactcacctgctcngcagatcggactcgaaccaaaagtaatagtcgtactttaagttacggtaaccaacgaagaacgccgaaggccaccggtccctggttcgttacgtgtaataactaagtaaacgactacgtaggacgacggccctagaacggatacctccgtggacgtacgttacttccgtcgtacggtccttaccgaagtccgtacggaacggggtacacggtacgtaacgtccgtaacgtttcggaacctttaacgtacgtaaggttaacggtaaccggtccgaggaccgtaagggaccggtacggaggttcctacgtaacgtttaaccttacgtacgtaaactaaacgtagtaaacgtaacgtaagggtaaacgtcggttaacttacgggtagggttttggggacgttacggggacggttaacggaacgcggttacttacccggtacggttaccgttaacggcccgaacggtaaccccggtgggtccctaccccgggtcccctaaccggg

SEQ ID NO: 202721 - DNA, 871 bp, Homo sapiens
  misc_feature: GYAE6OF02IZSSW.21.46.E02.1.454.CMB.1.raw
  modified_base (141)..(141): a, c, t, g, unknown or other
  misc_feature (141)..(141): n is a, c, g, or t
tcagtcgtcgctcgcacgaccggtgctcgatttagactcatctacagggaaagggggtgggtccaggaggcagaactctgggtgtctcaccatggcctggatccctctacttcctccccctctcactctctgcacgagctntgacggtcctcctagtcgagctacgaccacgaccgccctacccgtcggtagtccgagtccgtacccgaggaccgacggaccgggcctaaggactacccaccgtgtccgtcgcgacgtaagtcgtacgggtacctacggaaacctaaaaggtaattacgtacgtaacgtttaaggttaaccggtaaaaccgaacgaacggtaaaccgacccggtaacggaccccgaccggttcccggttaggtacggttaaggtacgttaaagttaacgttaaacgaacgaccgtaacttaggaaccgaccggttaccccagaacgttacgccttaaccggagtctaaccggttcttaccgttcgtaacgcctacccgacgttacgaccgggaagacgtaacgaccgtacgtaccggtaataccggttaataccgttacgtaacggtacggaaacctcgaaaccggtacgaggtaaccggccggaaggttctaaacggtaccgttaattaaccggataaaccgaaaggttacgaaacgtaacgtaacggttaaacggtcttaacgggtaacgtttacggttaccgggggttagggtaaccgggtacgggttaacccttaaaccggggtcccggttaccggttaacccggttaacccggtaacccgaacggggttaacccctaaccgggtaacccggttaccccgggccctttaaacccccggccccggtttaacccccggg

SEQ ID NO: 202722 - DNA, 871 bp, Homo sapiens
  misc_feature: GYAE6OF02HZS12.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccctctcactctctgcacaggctctgacgcctcctatgagctgacacagcccacccgtcggtgtcagtcgtccccaggacaggaccgccaggtactccacgtcgctcgtgactagacgtacggactacggaaacctaaaaggaattacgtgttactttaacgttacggtaaaccaaacgtaaggaacgtaccgacggtccccgaacgggtcccccttttagggttacggtttaacggtaggtaactttaaaagttaaacgttaaaaaaccgtaacgaacggttaacggaaccggtaaccgggtaccccttacggaaacggtacggtaaccttaccgtaggtaccgtccggtaactttcgtacgttacgggaccttaccgacgttaccggtaacggacgggaactccggaacgttacgaccggtttaacgttacggtaacttaccgtaaggtaccggttaacgtaaccggtaaccggtacgggaacggaacggtaacgggggtaacgtaacgggtaccggttaacgaacttttaaccgtttaaacgtaccgttaaaccgtaaaacggtaaacgttaacggaacggtaaacggttacggaaccgttacgtttacgtacgggtttacggggttacgggttaccgggacgggtaaccgggtaccgtaacgggttaccgtacgggtacccggttacgtaaccggttaccggaacggtaaccccggtaggtccccgttcccggtaccccgtttaccccggg

SEQ ID NO: 202723 - DNA, 728 bp, Homo sapiens
  misc_feature: GYAE6OF02GH9IF.21.46.E02.1.454.CMB.1.raw
  modified_base (133)..(133): a, c, t, g, unknown or other
  misc_feature (133)..(133): n is a, c, g, or t
  modified_base (233)..(233): a, c, t, g, unknown or other
  misc_feature (233)..(233): n is a, c, g, or t
  modified_base (262)..(262): a, c, t, g, unknown or other
  misc_feature (262)..(262): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctncacaggctctgacggcctctatgagctgacacacgccctacccgtggtgtcctagtccgtacccgaggaccacggaccggctaggactacaccgtgctcngcagagtacgactacgaacaaaagtaatntcgtactttagtaccggtaaccaagacgaacgaccgacggacccgaccggtcccttaggttaggttaacgtgtaaataagtaaacgtaagacctacggtaaggaccggaccgtaccccgtagaacgtaacgtcctcccgtaggtacgtcccgttattccgtacgtccggtacctaccgaacgtccgtacgggtaaccggacgtaccggtactaccgtacgtttacgtaactacttacgtacgtaagtacggtacggtacgacgggaagacggaacgggcggttagtacgacgttaacttaacgtctaaccggtaagtacgaaggtaacgtaaggtagtacggttaactacgttacgttcggggttaggtcgggttacggggaccgtacggaccgttaacgccggtaaccggtcccgtacgtacgtaaccggcggtaccccgaggttcccgtacccgtccgtcccgg

SEQ ID NO: 202724 - DNA, 683 bp, Homo sapiens
  misc_feature: GYAE6OF02GQ22T.21.46.E02.1.454.CMB.1.raw
  modified_base (348)..(348): a, c, t, g, unknown or other
  misc_feature (348)..(348): n is a, c, g, or t
tcagtcgtcgctcgcacgaccggtgctcgatttagactcatctacagggaaagggggtgggtccaggaggcagaactctgggtgtctcaccatggcctggacccctctcctgctccccctctcactttctgcacagtctctgaggcctcctatgagctgacacagccaccctggtgtcagtcgtccccaggacaaaccggccaggactccgacctgcttcgtgggatacttcattcggaccctaaaaagattactacttggttcggtaccagacaagaagtcacggtccacggccctgtacctggtcatccatggacggtccagtccgacgacaccgtcggactccgnggagcgtattcgctcgcctccagtctacggaaggtcaggttccggacctaacgtttgaacctatcccgtaagggtccgggacccgtagggtaccgggacgtaagtaggaacgtcgtacgtaaccttacgttagttcggttacgccgtaaacgtacgtacgtacggttaggttacggtactacgttacgggtacgggggtttacttccgggggaacggtaacgggacgttaacggttccgtaacccggttcgttacgggtacgaccgtaccggacggtcctcccggtaccccgtcggtacctaccgttccgttccgttacccccgtcccttacccg

SEQ ID NO: 202725 - DNA, 1025 bp, Homo sapiens
  misc_feature: GYAE6OF02F4NBT.21.46.E02.1.454.CMB.1.raw
  modified_base (195)..(195): a, c, t, g, unknown or other
  misc_feature (195)..(195): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacgaggcttcgtggacggtcctacctatggacgtctagaccacacgccctacccgtgggtntctagtccgtacccgaggacgacggacggccaggtatccgactgcctcgtgacgagtagtacggactacaaccgtaaaagtaatacgtagttactttagttaccggtaaaccaacgaagtaaccgccgacggaccgtaccggtcccgttggttacggtttagagtaacttaaggtaaacgtaacgtacctaacgtacgggaacggtacccggtacccctaaggtaacgtaacgttacccgttacccgtaggggtaaccggtcgtttaacccggtttccgttccggggttaccccgggtaccccgttaccccggtaaccgtacccggtaaccggggtaacccggggtaacttacccgggtaacggttaacccgggttacccgtttaaccgggttttaacggtaacctttaaacccggttaacggttaacgggtaaccggggtttaaacccgtaccgggttaaacggggaccgggttaaacggggaaccggggtaacggggtttaaaccggaacgggttaccgtttaaaaccggtttaccggtttaaaccgtttaacccgggttaaaaccgtaaaggttaaaccgggttaaggtaaacccggttaaagggttaacggggttactttaaccgggtaagggtttacgggttttaccggggtacgggttacccggggtacggggaaaccggttacccggtaaacggggttaccggtttaaccccggggaacccgggttttaacccgggttaacgggttaccccggtaaacccggggtacccggtaaccccggggtttccccggtacccccggtttccccccggggttaacccggg

SEQ ID NO: 202726 - DNA, 856 bp, Homo sapiens
  misc_feature: GYAE6OF02FSBKH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccacccgtcggtgtcagtcgtccccaggacagacggccaggactcacctgcctctgcgaagagtcggactacgaccaaaagtaaatatcgtctttaagttacggtaacccaaacgaaggaacgaccgtacggcccgaccggtccccctaggttcgttagtgaattactaaagtaaaacgacctacgtaggaaggtaccggtcccctacgaaggtagtaaccttaccccgaggtaacggaccggttactttcgtaccgtcgggtaccctaccgacggtacgttacggaaggggtaaccacggtaccgacgttaccgtaccggttagtaaacgttactacggtaacggtaacggtaacggtacccggtacggaaccggaacgggtaacgggaaaccgggtaacgggtacgtaacgttaacgtttaaccgtttaaccgttaacgggttaaacctaaaaccgtacggtaaagggtaaaccgtaaacggttaacgggtaacggtttaaccgttaagtttaacgggtttaggggttttaccggggttcggggtaccggggtaaccggggtaaccggtaaacgggttaccggttaacccgggttaaccccgggttaccggttaaccgggtaccggtaaccccggaacccgggttaaccgggtcccggttaccccggtaccccccggttacccggg

SEQ ID NO: 202727 - DNA, 754 bp, Homo sapiens
  misc_feature: GYAE6OF02FWKXW.21.46.E02.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagactcatctacagggaaagggggtggtaccaggaggcagaactctgggtgtctcaccatggcctggatccctctacttctccccctcctcactctctgcacaggctctgacgcctcctatgacgctgaccacacgcccacctcggtgtcagttccgacccgaggacacggacggccaaggactcctactgcttactgactagtancggactacggaaccaaaagaacttagcgttactttaagttacggaacctaacgaacgtaacggacccgtaacggacccgtaccggcccccgttagggttacgtttaacggtaacgttaacgttaaagttaaaacgttaaaacggaaccgtaacgttacggaaaccgggaccggtaccctaacggaacggacgtaccgttaccccggtgaaccggtacggttacttaccgtacggtcgtaccctccgtaacggtacgttacggaacggaccgacggtaccgtacgtaccgtacgttacgtcctaagtaccggagtacgacgtacgagtacggaacgacgggacgtacgtactacggtacttactacgtacgtaacaacgtagacgacgtaagtacgtaacgtacgtacgttacggttgggtccggtgggacggtaacggaccgtaacgtaccggttaccgttaaccgtggttacaccggaccgtacccggaccgtcccggtaccccgtccgtaccg

SEQ ID NO: 202728 - DNA, 806 bp, Homo sapiens
  misc_feature: GYAE6OF02G9FUM.21.46.E02.1.454.CMB.1.raw
  modified_base (199)..(199): a, c, t, g, unknown or other
  misc_feature (199)..(199): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtagtcagtcgtccccaggacnggaccggcaggatcacctgctctcgcagatcggacgtacgaccaaagaactatgtacttagttacggtaaccaacgtaagaacgaccgtaacgggccgtaccggtcccccgttagggtttgtttacggtagtaattaagttaaaataaacgacctaacgtaggaacggtaccgggtaccccttacgaacgggaacggtaacctccccggtaggacggtaccggttactttccgtcgttaccgggtcctacccggacggtacccgtacgggaacggggacctaacgggaccgtaacggttccgttaacggttacgtaacgttacgtaacggttaaggttaacggtaaacggttcccggaaaggggaccggtaaacgggaacggggaccggtacggttaccgttaggttaaaccttaagttacgttaacgtaaccgtaaaacggtacggtaagtaacgtaaggtaacggttaacgttaccgttagttagggttacgggttacgggtccgggacggggtaaccggtacggaacggtccgtaccgggtaccggttaccgtacggacgtaccggaccggtaacggttcccgtacccggtccccgttaaccgg

SEQ ID NO: 202729 - DNA, 733 bp, Homo sapiens
  misc_feature: GYAE6OF02HT7M5.21.46.E02.1.454.CMB.1.raw
  modified_base (350)..(350): a, c, t, g, unknown or other
  misc_feature (350)..(350): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcataggctctggaggcctcctatgagctgacacacgccctacccgtcggtgtccgacgtcgtaccccgaaggacacggaccggccaagggacttccaccgtgtccgtacgtcgacaaggactacgggaacctacgaaccgaaaaagtaattatgtactttagtacggtaaccaacgaagacgccgacggccgaccggtcccttaggttgttacggtntaattaagtaacgtaaacgacgtaacgtacggaacgaccggtaccctagaaggtacgtaccgttcccgaggtacggtaccgttactttccgtacgttccggtactaccgacgtccgtacgggacggaacacgacgttacggtaccttaggttacgtaaccgtcttacggtaacggtcgtaaccgtacggaggacgtaagggaacggacggacggtacctaggttaaccttattaaacggcgttaaaaccgaagtaggtaaacgaccgtaggtaccggtaacgttacgttgtaacgggtttggtccgggtaggtacggaacggacgaacgttcgacggtcctagtcgacgaccggtacgaccggtcctacccggtacccgtcgg

SEQ ID NO: 202730 - DNA, 777 bp, Homo sapiens
  misc_feature: GYAE6OF02HTJKB.21.46.E02.1.454.CMB.1.raw
  modified_base (152)..(152): a, c, t, g, unknown or other
  misc_feature (152)..(152): n is a, c, g, or t
  modified_base (224)..(224): a, c, t, g, unknown or other
  misc_feature (224)..(224): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacagctctgagcctcatganctgacacagccacccgtggtgtcagtcgtcccaggacaggccgaccaggactcaccgttgctcgtcgacagngtacgactcgaaaccaaagtaatagtcgtacttagtacggtaaccaaacgtaaggaccgtaccgacggaccgaaccgtccccgttaggtttacgttagtagtactaattaacgtaaacgacgtaacgtagaacggtacccggccgttacgaaacggtcgaccgttccgaggacgtaccggttaatttacccgtcgttacgtcccgtaccgtaacgaccgtacggtaacgggtaccacggaccttacggtaccgtacgtacgtaaccgttacgtcgttaaacggttacggtaaccgttaacggacggaaccggtagggaaaccgggttaacggaacgggttaccttaacgttaaccgtttaacgttaaccggttaacgttaaaaccgaaagtttaaggaaccgttaagtaaaccgggtaactaacggttaacgtttcgggttaaagggttcggggttaaccggtacggggacgggttaccggaacgacggtaccgttaaccggaccttacgggcctacgtacgtaccgacggttccgtacccggtccgttaccg

SEQ ID NO: 202731 - DNA, 716 bp, Homo sapiens
  misc_feature: GYAE6OF02JFHF6.21.46.E02.1.454.CMB.1.raw
  modified_base (366)..(366): a, c, t, g, unknown or other
  misc_feature (366)..(366): n is a, c, g, or t
tcagtcgtcgctcgcacgaccggtgctcgatttagactcatctacagggaaagggggtgggtccaggaggcagaactctgggtgtctcaccatggccctggatccctctacttctccccctcctcactctctgcacaggctctgaggcctcctatgagctgacacagccaccctcggtgtcagtcgtccccaggaccagacggccaggatcacctgctctgcagatggactgccaaaagaaactatgctttaatggtaccaaacagaacgccgaagcccaaggccccttgtagttagtgatataataaagactactagaggacggcccctacaagtaacgaactcccctagacgtcgtatttaccncgttacggcttccgaacgtccgttaccgagggggtaaacctacggtaacgtacgttaccgaaccggtttgaaccgttatccggagttaggaaaccggtacgtaggaaccgacggtaagggaaccgaagggtcctaggtaaccttaaccgtttaacgtacgttacaaaacgtaggtaacgaaacgaaggttaacggaggttaaccttacgtaaacggtttgggttacgggtttaccgggcgggtacgggaacccggtaaacgggacgttaacgggtaaccccgttacggttaacggttaaccggaccgtacccccggtaaaggtcccgtacccggtacccccgttaccggg

SEQ ID NO: 202732 - DNA, 765 bp, Homo sapiens
  misc_feature: GYAE6OF02FJ61N.21.46.E02.1.454.CMB.1.raw
  modified_base (88)..(88): a, c, t, g, unknown or other
  misc_feature (88)..(88): n is a, c, g, or t
  modified_base (392)..(392): a, c, t, g, unknown or other
  misc_feature (392)..(392): n is a, c, g, or t
tcagtcgtcgctcgcacgaccggtgctcgatttagactcatctacagggaaagggggtgggtccaggaggcagaactctgggtgtctnaccatggcctggatccctctacttctcccctcctcactctctgcacaggctctgaggcctcctatgagtctgacactagccacctcggtagtcagtgtccccaggacagacggccaggatcacctgctctgcagatcggactcgaccaaagaactatcggactttaatcggtaacccaacgaaggtaacgcctaagggccctaacgggtccccctaggttcgttaaggtacgaattaacgttaagtaaaacggtacctactaggaacggtacgggtccccctagaaggacgtacgttaccccgngtacgtacgtaacgtttcacgttcggtacctccgtagacctacgggtacggtaacgaccgtacgtaccggttacaacggttacgtaacttacgtaaccgtaaggttacgaaacggtaccctaagggaccgtaagggtaaccggacggttaacgggtctaacggttacttaacgtaccgttacgtaacgtaaacgtagttaaccgacgtaacggttaagtaacggttaaccgttacgtaaggtttacgggtacggttacgggtacgggtaacgggtaacccgtaaggtaaccggtacgggtaacccgttaccggttaaggtaccgggtaccgacccggttaagggtaccccgttacggtacccccgttacgggg

SEQ ID NO: 202733 - DNA, 802 bp, Homo sapiens
  misc_feature: GYAE6OF02IRSFM.21.46.E02.1.454.CMB.1.raw
  modified_base (731)..(731): a, c, t, g, unknown or other
  misc_feature (731)..(731): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctagacacacgcccaccctcggtgtcacgtcgtccccgaggaaccagaccggccaggtactccgaccgtgcctcgtcgcgagtagttcggactgaaccaaaagaaactagtcgtactttaagttcggttaacccaaacgacggaacgaccggacggaccccgaccggtccccccgtagttacggtttaacgtggtaaacctaagttaaaactaaaaccggtaacctaacgttacggaaacgggaacccggttacccgttaaccggaacggaaacgttaccgttaccccgtacggaaaccggtacgttaacctttccgttacggttcgggtacccttccggaacctccgttacggtaaccggggaactacggacccgtaaaccggtttccggtaaaccgttttacgaaccgttaacgttaccgtaaggtaaccggttaaggtacccgagggtacccgaaagggtaacggaccggacgggtctagtaccttaattacgtactaacgtaacgacgtagtaacgagtacgtaagtactcgttacggttgggtacgtcgggtacgggaccggtaacgnggtaccgacggttacccgtacggtagttaccgacggacccgtaaccggccgttcccgtccccggtacccgg

SEQ ID NO: 202734 - DNA, 780 bp, Homo sapiens
  misc_feature: GYAE6OF02JG396.21.46.E02.1.454.CMB.1.raw
  modified_base (282)..(282): a, c, t, g, unknown or other
  misc_feature (282)..(282): n is a, c, g, or t
tcagtcgtcgctcgcacgaccggtgctcgatttagactcatctacagggaaagggggtggtccaggaggcagaactctgggtgtcttcaccatggcctggatccctctacttcctccccctctcactcgtctgcacaggctcgtgaggcctcctatgagctgaccacaggccacccgtcggtgtacagtcgtccccaggacagaccggccaggactccacctgacgtctgacagagtggacctgaaccaaagaaatgtcgtacgtttagtcggtaacctaanacggaacgccgtacggccctacgggtccccttggttacgttagtacgtaatagtaactaaacggactacgtacggaacgaccggtaccctacgaagtaagtaccgtcccgtagacgtaccggtattcctacgttcggaccgtaccgtacgaccgttaccggaacgggtaccacgtaccgtacgttaccgtacggtttaccgaacgtttaacgtccggtaaacggttaccggtaaacggtaccgtaacggggtaaccaaggggtaaccgggaacgggttacgggtactaccgggttaacttaacgttaccgttaacgtaaccgtaaacgtaggtaacgtaccggtaagttaacggtacgtacgttaggtaacggttcgggtacgggttacgggacccggtaagggaccgtaacgggtacccttacgggtacccggttaccgttaagggtacctaccgggtacccggtaaccgtccgttaccccggccccggttaaccgg

SEQ ID NO: 202735 - DNA, 900 bp, Homo sapiens
  misc_feature: GYAE6OF02F6TWR.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctccccctcctcactctctgcacaggctctgaggcctcctatgagctgacacagcccaccctcggtgtcgagtcgtccccgaggacagaccgcaggatcaccgtgctcgtgcagatcggactgaccaaagaatatgcttattgtaccaacagaacgaccgaggccgacgccccgtgtcgttaggtacgatatataaacgactactagacgacgtacccgtacgacggtaagactacccgtagacgtcgtaacgtttcgtaccgttcggtccgtaccgacgtaccgttacggaaccacggggggggaacctaccgtaaccgttaccgtaaacccgggtttacgacgtttaaacgtttaacggtaacgggttaacgggtaaaccggttaacccgtaacggggtaaccgtaaacggggaaacgggtaaaccggggttaccgggtaccggttaacgtaacggtttaaacccggttttaccgtttaacggaaaccggttaaaaccgttaaagggtaaccgggtaaaacccggtaaggggtttaaaccgggaaaaccgggtttaacccttaacccggttttaaagggtttaaccgggggttacggggttttaacccggggggtacccgggggttaaacgggggtaaacccggggttaaaaccgggtaaccggtttacccggttaaacccccggttaaccgggttaaccgggttaccggttaacccgggaaaccccgggttaacccggggtaacccccggtttacccgggtttacccccccgggtttaaccccggg

SEQ ID NO: 202736 - DNA, 706 bp, Homo sapiens
  misc_feature: GYAE6OF02JILGO.21.46.E02.1.454.CMB.1.raw
  modified_base (179)..(179): a, c, t, g, unknown or other
  misc_feature (179)..(179): n is a, c, g, or t
  modified_base (380)..(380): a, c, t, g, unknown or other
  misc_feature (380)..(380): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacaggctctgagcctctatgagctagaccacacgcccaccgtcggtntccagtcgtccccaggacagaccggccaggactccaccgtgcctctgcacgatcggactcgacctaaaagaattcgcgtacgtttagtcgtaaccaacaggaacgaccacggaccgaccggccccttggttacgttaacggtagtaattaactaacgttaaaacgacctaacgtggaaccgacggtccctacgaagtaacnccttaccgaggacggtacgttattccttacgtcgccgtaccgtacggcgtaccggtaggaacctagaccgtacgttacgtacggttacgtacgtacgtacgtagtacgtacgtaccgcggacgacggaacggacgtagacttacgtaacgttactacgtacaacgtaactaacggataacggagtacgtaagttctacggtaggtttacgggttacgtaccggggacggttaacggaaccggtaaggtacccgtacggtaccccgttaacggttcggaacgttacccggaaccgttacggtaccggtacccgtccccgttaccggg

SEQ ID NO: 202737 - DNA, 786 bp, Homo sapiens
  misc_feature: GYAE6OF02G42SU.21.46.E02.1.454.CMB.1.raw
  modified_base (134)..(134): a, c, t, g, unknown or other
  misc_feature (134)..(134): n is a, c, g, or t
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (179)..(179): a, c, t, g, unknown or other
  misc_feature (179)..(179): n is a, c, g, or t
  modified_base (669)..(669): a, c, t, g, unknown or other
  misc_feature (669)..(669): n is a, c, g, or t
tcagtcgtcgctcgcacgaccggtgctcgatttagactcatctacagggaaagggggtgggtccaggaggcagaactctgggtgtctcaccagtggcctggatccctctacttctcccctctcactctctgcanggctctggaggcctctangagcngacacacgccctaccgtcggtntccaggtccgtaccccgaagggaccacggaccggaccgaaggactccaaccgttcgctacgtgactagagtacggactacggaaccaaaagtatatcgtactttacgtacgtaacaacgagtaacgccacggacctaccggtccctaggttcggtaagtagtaataacgttaaataacgtaacacgtaggaacggtaccggaccagaaagtcaacgtcccgagacgtagtctttacgcgtcggtcctaacgacgtcggtaacggacggttaacacgaacgtcgtaccgtaagttcgaaccgttaacgcgtttaaccggaagtaaccggtagaacggtcgaaacggggagggaccgtaggaccttacggacgtttaaacctagtaacgtaacccgtaaagtaaacccgtagtaacggtacgttaggtaaaccgttgaaccggttgggttacggggttacgtaccggggggaacgggtaacccggttaaccncgggggttttacccggaaccggttacccgggtttaaacccggggtaccgttaaccggaccccgggtaaaccggttaaccccgggtcccctaccccgggggttacccttaaccccggg

SEQ ID NO: 202738 - DNA, 822 bp, Homo sapiens
  misc_feature: GYAE6OF02IJEN1.21.46.E02.1.454.CMB.1.raw
  modified_base (185)..(185): a, c, t, g, unknown or other
  misc_feature (185)..(185): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctagacggcctcctatgagctcgaccacacgcccacccgtcggtntcgaggttcgtccccgaggacacggaccggccaggacttaccaccgtcgcttcgtcggaccagtacgtacgggaccgtacgaaaccaaaagtaaacgtactacgtacttttaacgttaacggtaaaccaaacgaacggaacgaccggacggacccgaccggtccccgttaggttacggttacggtacgtaacttaaagtaaactaaaacggaacgtacgtaggaacggtaccggtacccttaacgaacggtacgttaaccgtaccccgtagggacgtaccgttactttacccgtacgttccggtacctccgtaacgtccgttaacgggaacggtaacgacgtaaccgtacggttacgtacgttaacgtacctttacgtaccgtaggttaacgtaaccggtacgacgggacgtaaacgggacgggtaacggtacggacgtttacgtaactttaacgtttaacgtaccaaaactaacggtacggttaaacgaacgtaacgggtaagtaacgttcgtaacggtttggttaccgggtagggttaccggacgggaaacggtcgaacggtaccgtacggacccgtttacggacggtaccgaccgtaacgtaccggtacccgtccccggttacccgttacccgg

SEQ ID NO: 202739 - DNA, 678 bp, Homo sapiens
  misc_feature: GYAE6OF02I51A2.21.46.E02.1.454.CMB.1.raw
  modified_base (107)..(107): a, c, t, g, unknown or other
  misc_feature (107)..(107): n is a, c, g, or t
  modified_base (114)..(114): a, c, t, g, unknown or other
  misc_feature (114)..(114): n is a, c, g, or t
  modified_base (135)..(135): a, c, t, g, unknown or other
  misc_feature (135)..(135): n is a, c, g, or t
  modified_base (189)..(189): a, c, t, g, unknown or other
  misc_feature (189)..(189): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (386)..(386): a, c, t, g, unknown or other
  misc_feature (386)..(386): n is a, c, g, or t
tcagtcgtcgctcgcacgaccggtgctcgatttagactcatctacagggaaagggggtgggtccaggaggcagaactctgggtgtctcaccatggcctggatccctntacttcnccccctctcactctctgcacnggctctggacggtccctacctagtgacgctagaccacacgccctaccgtcggtnacgagttcgacccaggcgaggacggccaggtctccaccgtgcctcgtcggaacaagttagtcgggaccaggaacctaaaaagtaatgtcgtacttagttacggtaaccaagacgtaacgaccgacgcccgtacggtccctgttacgttgtagaatataataacgactacgngacgcgtacccnagacgtactcgagngactcttctcgtcggtcaacgtcgacgacggacgtaacgtcgacgtcgtacgtacgtaacgtctaccgttagaacgtacggtaacggacggacgtacgaacgggacgacggttacggaccgttaggtaactacttacgttacaaacgtaaacgttagaacgtacgtaacgtagtaacgtttaccggagtttaagggtttccggaacggtttccgggacggacggaacggtcgtccggtacgtacccgtaggtacgtaccgcggtacccgagttccgtacccgtcccgaacgg

SEQ ID NO: 202740 - DNA, 773 bp, Homo sapiens
  misc_feature: GYAE6OF02IOXND.21.46.E02.1.454.CMB.1.raw
tcagtcgtcgctcgcacgaccggtgctcgatttagactcatctacaggggaaagggggtgggtccaggaggcagaactctgggtgtctcaccatggcctggatcctctacttctccccctctcactctctgcacaggctctgaggcctctatgagctgacacagcccacccgtgggtgtcagtcgtccccaggacaggaccggccaggctcacctgcttcgtcgcagatggactacgaaccaaaagtaaatatcgtactttaagttacggtaaccaaacgtaggaacgaccgacggaccccgaacgggtcccccgttaggtttacggtttaggtacggtaattaacgttaaaagttaaaacggacgtaacgttacgggaacggtaccggtaccccgttcgaaaggtacggtaacccgttaccccgtaagggacggttccgttaacttttcccgtacgttccgggaccttccgacggtccgtacggaacgggacacgtaccgtacgttacgtacggttactaacgttacgtacggtaaggttacggaaccggttacggaacggtacggagggtacgggacgggacggtacgttacgtaacgtttacgttaacgtacgtaaacaaaggtagtaagacggtagtaacggttacgtacgttacggttggttcggggtaacgttccggggagggtaccggacggtaacgtcggttaccggaccgttacggtaacgccgtaaccggtccggacggtccctcccgggtccccttaaccgg

SEQ ID NO: 202741 - DNA, 976 bp, Homo sapiens
  misc_feature: GYAE6OF02I7LFU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcgagtcgtccccgaggacgagaccggccaggactccaccgtcgctcgtcgacagacgtcgggactacgaacccgaaaaagtaaacttaagttcggtacctttacggttaccggtaaaccccaaacgtaacggaaaccgcccgacgggccccgtaaccgggtcccccgttggttacggtttaacggagtaacttaaagtaaacgtaaaacgtaccgaacgttacggaaccgggtaccggggtaccccctacggaaacggtaacgtaccgttcccggtaggtaacgtaccggttaactttccgttaccggtcgggttccccttaaccggaccggttaccgtaaccgggaaaccggggggaaccctaacggggtcccgtaaaccgggttccgttaaacccgggtttacgaaacccgtttacggtaacggtaaagggttaacggttaaacccgggtacccggaaacggggtaccggaaacggggtaaccggggtaaaccgggtaccgggttaaccttaccggttttaaaacccgtaaaccgtttaacccggttaaacgtaaacccggttaaaaaccgttacgggtaaaccggtaacgtaaacggggtaaaccgttaaccgggtttaccttaaccggtttaggttaccgggggggtttacggtaaccggggttcggggaaacccgggtaaccgttaacgggaccgttaccgggtaaccccgtacgggtttaaccgggtaaccggtaccggtaaccccgggtaaccggtttacccggtccccggttaccccggttacccgg

SEQ ID NO: 202742 - DNA, 737 bp, Homo sapiens
  misc_feature: GYAE6OF02JETKP.21.46.E02.1.454.CMB.1.raw
tcagtcgtcgctcgcacgaccggtgctcgatttagactcatctacagggaaagggggtaggggtccgaggaggcagaactctgggtgtctcaccatggcctggatcctctacttctcccctcctcactctctgcacaggctctgagcctcctatgagctgacacacgccaccctcggtgtcagtcgtcccaggacagacgccaggatcacctgctatcgacagatgggactacgaccaaaagaatatgtacttagttacggtaaccaataacgaaagccgaacggaccgtaacggtccccttggttacggtttagtagtacttaaagtaattaaaacgaaccgtaacgtaggtaacggaaccggtaccctaccggaaaggaacgtaccttacccgtaacggaacgcgttaacgtttccctacggttcggtaccctaccgtacgttacgtaaccggtaagggaactacgtaccgtaacgtacgttaacggtttacgtaactttaccgaggtaggttaaacgacgggttacgaggacgtaagggaacgggtacgaacgtcgtaaccgttaactacgttttaaccgactaaacgtaaacgaggtaaacgacgttaaaggtacggtaacgttaacctagttaacggtttgggtagttaccggggacggtacggaactaacggtccgtagtaccggtacgtacgacgtaccgaccgacgggtccctaccggtcccggttacg

SEQ ID NO: 202743 - DNA, 682 bp, Homo sapiens
  misc_feature: GYAE6OF02J2O98.21.46.E02.1.454.CMB.1.raw
  modified_base (326)..(326): a, c, t, g, unknown or other
  misc_feature (326)..(326): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (402)..(402): a, c, t, g, unknown or other
  misc_feature (402)..(402): n is a, c, g, or t
  modified_base (465)..(465): a, c, t, g, unknown or other
  misc_feature (465)..(465): n is a, c, g, or t
  modified_base (522)..(522): a, c, t, g, unknown or other
  misc_feature (522)..(522): n is a, c, g, or t
tcagtcgtcgctcgcacgaccggtgctcgatttagactcatctacagggaaagggggtgggtccaggaggcagaactctgggtgtctcaccatggcctggatccctctacttcctcccctctcactctctgcacaggctcgtgacggcctcctatgagctagacacgcgcctacccgtcggttagcaggtccgtaccccgaggacacggaccggccgaaggactccgacctcgccttcagccgagagtcggactacggaaccaaaagtaatgtcgtactttacgtacggtaaccaagacgacgccgacgcacggcctggtagtagngtacaagtaactaagacacgtaggacgacgtaccngaacgancctcgagcgtancttcgtcgtcgctccgactcgngaacggcttaacgcgtacgtactcggttaacaacgtactacggtagtacgaacgtcgaacggngaaggacggtacgaggtactaccgtaagttactaacgtcaaacgtaacgagtaaacnggttaaacgaacgggtctttactaacgggttgggttacggggtttaccggcggggaaccgtacgggtaaccgtaacgtaccggttccgaaccgggtttacgtaccgggacgtaacccggaccgggtcccggtacccggttttccccggccccggtttaac

SEQ ID NO: 202744 - DNA, 733 bp, Homo sapiens
  misc_feature: GYAE6OF02GDMMA.21.46.E02.1.454.CMB.1.raw
  modified_base (460)..(460): a, c, t, g, unknown or other
  misc_feature (460)..(460): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtgtcagtcgtccccaggacagacggccaggactccaccgtgcctcgtgcagagtcggactcgaaccaaaagaaattgtcgtactttaacgttcggtaacccaacgaacgaacgacccgacggacccgaaccgggtcccccgttaggtttacggtttaacggtagtaagttaagtaaacgtaaaacggaacctaacgtaggaacggaccgggtaccctagaagtacgtacctcccgtagacgtcgtacttcgtcgtcggtcctccgagtccgtaggacggacncgacgtacgtctaacgttcgacttagacgtagtacggacgtacggacggacgaagggaacgggacgacggtcgtaacgtactttaagttacgtacgtaaacaaagtaacgtaacggacgtaaggtaacgtaacgttacgttaggttaggttcgggtacgggtcgggtacggggtacggtaaccgtacggtacggttacccgtaacggttaccgtacggaccggtaacccggtacccggtaacggtcccggttaccccggtccccgttacccgg

SEQ ID NO: 202745 - DNA, 826 bp, Homo sapiens
  misc_feature: GYAE6OF02GF87G.21.46.E02.1.454.CMB.1.raw
  modified_base (170)..(170): a, c, t, g, unknown or other
  misc_feature (170)..(170): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgctacaggctctgacggtcctactagtgagtctgacacncgtcccacccgtcggtagtccgtagttccgtccccgaggacaggaccggccgagggtactcctaccgtcgtcctcgtacggacgtagtagtacgggtaccgacggtaaaccgaaaaagttaacttacgtacgtaacttttaaccggttaacggtaaacccaaaaccgaaaggtaaaccgaccggtaccggtaccccgtaccgggtacccccgtttaggttaccggttaggttaagtaacgttaaacgtaaacgttaaacgaaccgacgtaaggacggtacgccttacgaagacgtaccgtccgagacgtcgtacgttcgtcgtacgcctacgactcgtacggacggacaggcctcgtaccgtaacggttcgacttactacggtacgttacgtacggtacggacgtaacgggacggtaacgggacggttcggtaactaccgttaacggtttaacgttagtaaccgttaacggtaaacgtaggtaaccgtaaggtaacgtaacggttaccgtaacgttacggtagggttaccggggttacggaccggggtacgaacgggaaccctgggtaacccgttccggtaacccggttacggtacccggtaactcccgggttaaaccgggacccgttccccggtacccgggtaccccgttaccgg

SEQ ID NO: 202746 - DNA, 521 bp, Homo sapiens
  misc_feature: GYAE6OF02HWOCW.21.46.E02.1.454.CMB.1.raw
  modified_base (314)..(314): a, c, t, g, unknown or other
  misc_feature (314)..(314): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (457)..(457): a, c, t, g, unknown or other
  misc_feature (457)..(457): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagatggactgaccaaaagaatatgacttattggtaccaacagaagccaggccaggcccctgtgttagtgatatataaaagcactgagaggccctnagagatcccgtgacgcgtattctctggctccagctcagggacagcagtcacgttagactatcagtgaacgtccaggcagacggagaggctgacttattactgtacaaanagtaganagtagagtactgagttgggtgttcggngggtaaggaccgaagcgtacgaccgtacgtacggtacacggcccaaggctaccgcccctaccgg

SEQ ID NO: 202747 - DNA, 801 bp, Homo sapiens
  misc_feature: GYAE6OF02I1RJZ.21.46.E02.1.454.CMB.1.raw
tcagtcgtcgctcgcacgaccggtgctcgatttagactcatctacagggaagggggtgggtccaggaggcagaactctgggtgtctcaccatggcctggatcctctacttcctccccctcctcactctctgacacgaggctcgtaggacgtcctctatggacgcagaccacagcccaccgtcggtctcgtagtcgtcccgaggacacggaccggcgaggtctaccgaccgtgaccttgacgacgagtacgtacggaactccggaaacctaaaagtaattacgtacgttaccgtttaagtaccggtaaaccaaacggtaacggaaccgaccgaccggaaccgtacccggtcccttagggttaggttagtagtaacttaagtaacgtaacgacgtaacggtaggacggaccggacctagtaacgacgtaccgaccggttagacgtacgttacttacggtcgttacgaccttcccgaacgtcgtaacgggaacggtacacggtaccgtaacgtacgtaacgtttacgtaacgtacgttaccgaagtacggtacgtacggaacggtacgtaacggggaacggtaccgggtacggtaaccgttagttaaaccgttagtaacggttaacctaaaccgaaacgtaaacgaacgtacgtaaagggtaacgtacggttaaccttagttaagggttacgggttacggggttacggacgggaacggtaaccggtaggttaccggtacggtaccggttaccgttacggacctaaccgggccgtttaaccggacccggttcccgacccgtaccg

SEQ ID NO: 202748 - DNA, 764 bp, Homo sapiens
  misc_feature: GYAE6OF02J16O6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagtctgacacagcccaccctcggtcgtcagtcgtccccaggacagcggccaggactccacctgctctgcagatcggactgaccaaaaggaattagtacgtactttaacgttacggtaacccaaacgaaggaaccgaccgaacgggtacccgtaacgggcccccctttaggttacggttaacggtacgtaataaacttaaacgttaaaacggaacctaacgttacgggaacggaaccgggtacccccttagaacgtacgtacccgttaccccgttaggacggtaccgtactttcccttggtacggtcccgtaccgtaacgtccgtaccgaaggggaaccaacggtcaccggtaccgttacgttaccgtacgttacgtcgtaagttcggtaaccggtcgaacgggacgtaacgggacggtacgtacggtacttaccgtaacttaccgttacgtacgtaacctaaacgtagtaacaggtacgtaagtacgttatcggttacggtagggttaccggttcgagggttaacggaccgtacggtccgtaacgggtacccttcggaacggttacgacccggtaccggtaaccggtccgtaccccggcccgttaacgg

SEQ ID NO: 202749 - DNA, 788 bp, Homo sapiens
  misc_feature: GYAE6OF02H0IX8.21.46.E02.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagactcatctacagggaaagggggtggtccaggaggcagaactctgggtcgtctcaccgatggcctggactcctctacttcctcccctctcactctctcgcacgacggctctggacggtccttactagtgacgctacgaacacgaccnccctaccgttggtcgtcgtacggtccgacccgaaggacgacggaccggcgaggtactaccgaccgttcgtcctcgtcgacgtacgcggttacggaactacgaaacgaaaacgtattacgtgttaaccgttttaaggtaccgaaaccaaacggtagaccgaccgacggaccgtccgggtaccttggttaggttacgacgtaattaaagttaaacgtaaacggctacggtaacggaccggtaccggacccttagaacgacggtacgtacctgggacgttacttcgttccgtcgtcggactacggtacgtccggacggacgtacacggtgtaaccgttcgtaaggttcgaactacggtacgttaggaacgaccggtacgacggaacgacggacggttacggaacgttcgttaacgttaattcgttaacgtaggaacaacggagttaacgaacgtagtaacggtacttcgtacgggtttacggttcggggtaacgttcggggtacgggaaccggtaacgtaccgggtaccgttaccggtaacccggttcggttaacccggaccgggtaccggtaacccggttccggaccggttccccggtcccgtttaccg

SEQ ID NO: 202750 - DNA, 850 bp, Homo sapiens
  misc_feature: GYAE6OF02JLYAC.21.46.E02.1.454.CMB.1.raw
tcagtcgtcgctcgcacgaccggtgctcgatttagactcatctacagggaaagggggtgggtaccaggaggcagaactctgggtgtctcaccatggcctggatccctctacttctccccctcctcactctctgcacaggctctgaggcctcctatgagcctgacactagccacccgtcggtgtcagtcgtccccaggacagaccggccaggatccacctgtctctgcagatcggactcgaaccaaaggtaaatagtcggtactttagttacggtaacccaaacgtacggtaacgccgaacggtaccccgtaccgggtacccccgttaggtttacggttaacggtacgtaagtttaacgtaaacgtaaaaacggacctaccggttaaggaaccggtacccgggtacccccttacgaaacgggtaccttacccggttaccccgtaggtaaccgtaccgttaacgtttacccggtaccgttacgggccccttaccgtaaccgtaccggttaaccggtaaacgggaccgtaccggtaccgtaacgttacccgtaaggtttaccgtaaccctttagtacccggttaaggaccgtaaacgtccggaggtacgaagggtacggacggtacgtcgtacgtaacttaacgttcgtacgaaccgtaaagtaggtaactacgtaacgttaggaaccgttaccttaaggtcggtttacggggtacgttacggggtacgggaccgggtaacccgtacggttaaccggttccgggtaacccgggttacccgttaagggttaacccggaccggttaacccggtaacccgggtttccgttacccccgggccccgttttaacccggg

SEQ ID NO: 202751 - DNA, 775 bp, Homo sapiens
  misc_feature: GYAE6OF02IZ6PW.21.46.E02.1.454.CMB.1.raw
  modified_base (179)..(179): a, c, t, g, unknown or other
  misc_feature (179)..(179): n is a, c, g, or t
  modified_base (555)..(555): a, c, t, g, unknown or other
  misc_feature (555)..(555): n is a, c, g, or t
  modified_base (768)..(768): a, c, t, g, unknown or other
  misc_feature (768)..(768): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctctagtgagtctagacacacgccaccgtggtntcgagtccgcccaggacacggaccggccaaggtactccgactcgacttacgagacaggtactacgggaacgtacgaaaccgtaaaaagaaagttcgttagtaacgtttaaggttaacggtaaaccaaacgaaaggaaccgaccggtacggacccgtaccggtaccccgttaggtttacggttacggtacgtaataaacgttaaaagtaaacggaacgttaaccggtaggaacggtaacccggtacccttacggaacggtaaccgtaccgttacccgtaggacgtacggttactttcgtaccgttcgggacccttacgacgtactacggtaacggaacgtaccggtaccgtaacctacgtttacgactttaacccgnggtacggggtaccgggacggtagggtgaacggtagtaaggaacgtccgtaacgtaacttaacgttacttaacggttacccgactaaccggagtaacgtacggttagtacgttaacgtagtacggggtaacggtcggttacggacgggtacgacgttaggtccgtaacgtcgtacgtaccaccggaacgtcgtacgcccgttccacggttaccncgttccg

SEQ ID NO: 202752 - DNA, 776 bp, Homo sapiens
  misc_feature: GYAE6OF02GE30D.21.46.E02.1.454.CMB.1.raw
  modified_base (756)..(756): a, c, t, g, unknown or other
  misc_feature (756)..(756): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgtcggtcgtcagtcgtccccaggacacggaccggccaaggactaccaccgtgcctctgcagagtacggacctcgaaccaaaaagtaaacttgtacgtacgtttaagttacgggtaaaccaacgaagaaccggccgtaacgggaccccaacgggtccccccgttaggttacggttaacggttacggtaacttaacgttaaaggtaaaaccgtaaccgtaaccgttagggaaccggtaaccggtcccccgtagtaacgaccggttaacctaccgtacggacgtaccgttacttccgttcgtacgtcccgtaccgtacgtacgtacggtaacgggtaaccgacggtaccgtaacgttacggttaacggttcggtaaacttccggttacggtaaacgttacggaaaccggttaccggacggtaacggaagggtaaccggacgggtaccgtacgtaacgttaacttacgtttaagtaccgtaaacgaacgtagtaacggtacaaggttagacgttacgtacggttacgttgggttagtacgggacggtacgaaccgtgtaccgcgtaccggtctacggctacgaccgngtcccgtccgacccttccgg

SEQ ID NO: 202753 - DNA, 749 bp, Homo sapiens
  misc_feature: GYAE6OF02GYU2X.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctggtgtcagtcgtccccaggacagacgccaggatcacctgctctgcagatggactgaccaaagaatatgtacttattggtaaccaacaagtaacgaccaggacccaacggtccccctgttacgttacggtagattaataagtaaaagaccacgtaggaaggacgggtccctacgaggtagacttcccctaggaacgtcgtactttccgtcgtacggtcctaccagtccgtacggacggggtacacggcgtacggtaccgtaacgttacgtaaccttacgtacgtacggttacggaacgttaccggaaggtaccgtaagggaacgggaaccggtaacggggtcctaacgggttaaaccgttactttaacggttacgtaaaccgtaaacgtaacgggttaaacgaacggtaacgttaagggtaaccgttaacgttacggttaaggtttcgggggttaggttaccgggaccggggtacgggtaaccgtaacgggtccgttaacggtacccggttaacccggtaaggttacccgaccggtacccgtaaccgggtaccgttacccggtacccccgttacggg

SEQ ID NO: 202754 - DNA, 599 bp, Homo sapiens
  misc_feature: GYAE6OF02F8LIO.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatcggactgaccaaaagaaatatcgtactttagttcggtaaccaagagaacgccaggccaacggcccctgtgttagtgaatataataaagacacgtgagacgccctagagacactccgtgacgcgtattcgtcgtgtctccgagtctcgaggacagcagtcacgttacactagtcgagtcgaacgtcgacggacaggaacggacgacggctagtactattacgtagtaaccaaagtagtaacgagtacgtaaggaacgttacgtagtaggttcgggttacgtacgggacgggaacggtaccgaagggtccgtacggtacccgttcgtaacggtaccgaccggtacccgaggtcccgtacccgtccccgttaccgg

SEQ ID NO: 202755 - DNA, 622 bp, Homo sapiens
  misc_feature: GYAE6OF02FNLCF.21.46.E02.1.454.CMB.1.raw
  modified_base (313)..(313): a, c, t, g, unknown or other
  misc_feature (313)..(313): n is a, c, g, or t
  modified_base (379)..(379): a, c, t, g, unknown or other
  misc_feature (379)..(379): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagagtggactgaccaaagaatatgcttattgtaccaacagaagccaggccaggcccctgtgttagtgatatataaagacatgagacggccctanagagactcccgtagagtcgattctctcggcctccgacgcgtcgaagggacagacagtactacgttnactatcgaagtagaacgtccgagggacgaagggaaggaaccggtagggactaggtaaccttaagttacgtacgtaacgaaacgtaggtaacgaacgtagtaaggacggttaacgtacgtaggttagggttcggttcgggacggtacgggaaccgtaaggccggtaaccgtacccggttacggtaacgggttaccgtacgggtaacccgtaacgggtccgttaccccggtacccccggtaccgg

SEQ ID NO: 202756 - DNA, 825 bp, Homo sapiens
  misc_feature: GYAE6OF02I825I.21.46.E02.1.454.CMB.1.raw
  modified_base (209)..(209): a, c, t, g, unknown or other
  misc_feature (209)..(209): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctccactctctgcacaggctctgaggcctctatgagctgacacacgccaccctcgtagtcagtgtccccaggacagacggccgagganccactcgctctgcagagtggacctggaccaaagtaaaactatgtactttacttacggtaaccaaacgaacggaaacgacccgtaacggacccgaccgggtaccccccgttggttacgtttaaggtacggtaattaagtaaacgtaaaaacggtaaccgacgttacggtaacggtaccgggaccccttacgaacggaaacggtaacctttacccccgtaggtaaacggtaccgttaagtttccgttaccgttcgggtacccttacccggacgtaccgtacggtaaccgggggaaccaacggtaccggtaaaccggtttacctaacgggttttaaccggtaacctttaaccgttaacgaaggtttaaccggaaaacggttaacccggaacgggtaacccgaagggtaaacccgggaacggtaaccgggtacgtaaccgtaacgtttaactttaacgggtaacgtaaactaaagaaaggtaacaccgtaaggtaacggtaacggtaaccttatacggttagggtcggttacgggacggaagggtaccggaaacggttcgtacggtacgtcccgtaaggtccgaacggacccggtaacgtcccgtaccggtccccgtacg

SEQ ID NO: 202757 - DNA, 904 bp, Homo sapiens
  misc_feature: GYAE6OF02HD9PR.21.46.E02.1.454.CMB.1.raw
  modified_base (652)..(652): a, c, t, g, unknown or other
  misc_feature (652)..(652): n is a, c, g, or t
tcagtcgtcgctcgcacgaccggtgctcgatttagactcatctacagggaaagggggtgggtccaggaggcagaactctgggtgtctcaccatggcctggatcccctcttacttccctccccctcctactacctctcgtgccagacgtctcgtggacggtccctcctagtgacgctagaccacgaccgcccctacccggttcggttcgtaccgtaggtcccgtaccccggaaggaaccgacgggaccggtaccggaaggtactacccgtaccgtcgtccttcgtcggacgaagtaggtacggtaccgtacggaaaccgtaaaaagtaaacttagtacgttacgtttaaggttaccggtaaaccaaacggaaggaaccgaccggaccggacccgaccccggtccccgttaggttaggttaacggttagtaagttaattaaaacgtaaacggtaacctacggtacggaacgggtacccggtaccctaggaaggaacgtacccgttcccgtagggaaccgtcggttacctttcgtcgggtacggcccttaccggacgtacccggttacgggaacgggtaaccgacggtaccgtacggtaccgtttaaccggttacgtaaacgttaccgtacgtaagggttaacgaccgtaccggnggtaacgaacggggtacggaccgacggtacttagttaacgttactttaaccgtagtaaaccgaaacgtaggtaacgtaacgtagggttaaaccggttaacgttacctttaagggtcgggtttaacgggttcccgggtagggacccggggtaacggacccggtaacgttcccgggtacgttaaccccggtacgggttaagtaccccggaaccgtaaccggttacggtccccgtacccggttacccccggtccg

SEQ ID NO: 202758 - DNA, 640 bp, Homo sapiens
  misc_feature: GYAE6OF02GA6X5.21.46.E02.1.454.CMB.1.raw
  modified_base (176)..(176): a, c, t, g, unknown or other
  misc_feature (176)..(176): n is a, c, g, or t
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgagcctcctatgagctgacacagccaccctggtntcagtcgtccccaggacagacggccaggatccacctgctctgcagntggactgaccaaagaatatgacttattggtaccaanaagaacgccaggccaggcccctggtgttagtgatataataaacgacactggagacgccctacgagatactccgtaggacgcgtaacttcgtacgtggtcctaccgacgtcgtacggaacgggaccaggaccgtagttccgacgtttacggaacctttagtaccgtagtagtaacggttacccggaaggacgaaggacggtaacggacggttacctaggttaacccgttaattacgttacgtaaccaaagtaggtaagacgtagtaagtacggttactacgtaggtttcgggtgttcgggacggtaacggaccgtaaggaccgtaggtaccccgtcgttaacggacctacggacccgagggtacccctcccgaccccggttcg

SEQ ID NO: 202759 - DNA, 756 bp, Homo sapiens
  misc_feature: GYAE6OF02HACGV.21.46.E02.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
tcagtcgtcgctcgcacgaccggtgctcgatttagactcatctacagggaaaggggtgggtccaggaggcagaactcgtggtgtctcaccatggcctaggatccctctacttctccccctctcacttctctgcacgaggctctagacgcctcctatgagctgacacacgccaccctggtgtcagtcgtccccagtacgagccggccaggatcactgccttacncgcagntcggactcggacaaaagtagtacgtntaccgttagttacggtaacctacgaagaacgaccgtacggacctacggacccccttaggtaccgttttaaggtacgtaacttaacgttaacgtaaaacgtacgtaaccgtacggttacggacccgtacccgttaagaccgtaacgtacccggtacgtacggtaccggtaacgttccgttacgtcggtttccgaccgttacgtaccggtaccgtaacgggacgtacggtaccgtacgtacgttccgtaggtaccgtaacgtacgtaacggtcgtaaggtaccggtacgaccgggtaacgtacgggaccgggtaagccggttaacgacgttacgttaccttaacgggtacctaaggttaaccagggtaaccagtacgtacggtagtacgttacgtacggttcggtaggtaccggacggaaccggtaggtaaccgacgttccggaacctttagggtaacccaccggtactaacccggcgtacccgtcccggtacccgttacccg

SEQ ID NO: 202760 - DNA, 701 bp, Homo sapiens
  misc_feature: GYAE6OF02HWA6G.21.46.E02.1.454.CMB.1.raw
  modified_base (136)..(136): a, c, t, g, unknown or other
  misc_feature (136)..(136): n is a, c, g, or t
  modified_base (328)..(328): a, c, t, g, unknown or other
  misc_feature (328)..(328): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacnggctctgacggcctcctatgagctgacacacgccaccctcggtgtcaggtcgtccccaggacgacgaccggaccaggactccacctgctctcgacagatggactacgaaccaaaagtaatactagtcttagttacgtaaccaacagaacgacgacggaccgaggccccttgtacgttagtacgataattaanaaacgacgtacgtagacgacggtccctacgaagacgtactcccgtaggacgtacgtacttaccgtgtacgcctaccgagtcctacggacggaacgagaccgtacgtaccgtacgttacgtacgtaacgtcgtaaggtacggtacgtcggacggacgaagggacgggtacgacggtcttaacgtaactttaaccgttacgtaaccgtaacctaaaagtcggtaaagtacggtaaagttacggtaacggttacttaggtacgggtttaggggttacggttacgggtaccgggaggtaacccggaaggtcggttaaccggtaccgttcgtaacggccgtaacggacccgtacggtcccgtaccggtccctacccgg

SEQ ID NO: 202761 - DNA, 672 bp, Homo sapiens
  misc_feature: GYAE6OF02JVB68.21.46.E02.1.454.CMB.1.raw
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (320)..(320): a, c, t, g, unknown or other
  misc_feature (320)..(320): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctagtgagctagacacacgcccaccctcggtgtcagtcgtccccaggacagacggccaggactcaccgtgctcngcagngtcggactgaaccaaagaatctcgtacgttacttacggtaaccaacgaagaacgccgaggccgacgccctggttgtagacgtatactaanaacggactacgtgacgacggcctacgagacgactaccgtgagtccgtacttcctcgttagggccctaccgtagtccggtacgtaacgggactacggctacggtctaacgttcgaactacgtacgtaagtacggacgtacgaggtaccgaaggtacggacggtacggacttagtaaccgtttaagttaccgtacggttaacaaaacgtacgttaacgggaacgtttaacggtaacgtaacggttaccttaggttaacgggtacgggttcgggttacggacggtaacggggactaacggtacgcggtaccgtacgtaggtccgacggaccccgaggtccgtccccgtgtacccg

SEQ ID NO: 202762 - DNA, 902 bp, Homo sapiens
  misc_feature: GYAE6OF02GS6T1.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctggtgtcagtcgtccccaggacagacggccaaggatcacctgctctgcagatggactcgaaccaaaagaaactgtcgacttaagttcggtaaccaaacgaagaaacgaccgaacggccgaacggccccctggtaggttaagtacggtaataacgtaataaaaacggtaacctacgtacggtaacggaacgggtaccccttaaccgaaggtaaggtaccttaccccgtaggtaacggaccggttaaacgtttccttacggttacggggtacccttacccgaacggtccgttaaccggtaacgggaacccgtaacggacgtaacggttacccgtaacggtttaacgtaaccgttaacgtacggtaaacggttaacggtaaaccggttcccgtaaagggaccgtaagggaaaccgggaaccggaaggggtaccctaagggtaaacctttaaacgtttacggtaacggtttaaaacccaaaaacggtaacgttaaacgggtaaacccgtaaagggttaaacggtaaaccgggtttaaactttacggttaaacggttttacgggggtacgggttttacccgggggacggggttaacccggggtaaaccgtaaaccgggtacccggttaaccgggtaaccccggtttaacccgggtaaccgggtttacccgaacccgggtaacccggaaacccggggttacccttaaccccgggttccccccgttaacccgggg

SEQ ID NO: 202763 - DNA, 1055 bp, Homo sapiens
  misc_feature: GYAE6OF02IKWJ3.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggctcgtggacggcccttctagtgagtctagaaccacgaacgcccctacccgtcgggtcgtacgtacgttccgtacccccgaggaccgacggaccggaccgtaaggactaccgacccgttggtccttacgtacggaccgtaaggtaacgttacggggtaaccctacggaaaacccgtaaaaaaaggtaaactttagttacggttaaccgttttaacggtttaaaccgggtaaaccctaaaacgaaaacgggtaaaccggacccggaaccgggtaaccccggaccgggttacccccgtttaggggtttacgtttaacgggttagtaaagtttaaacgtaaaacgtttaaaagggaaccctaaccggttaaggggaaaaccggtacccggtacccccgttacgggtaaacggtaaaccgttaaccgttaccccggtaaggtaaccggttaccggtttaacttttaccccggttacgggtacccgggttaccccttacccgaaacggttccgttaaacccggggacgggggtaaacctacggttacccggtaacggtttaacccgttacgggtttaacttaaccgtttagtaacccggtaggtaacggtaaaccgggtaccgaacggggaacctaagggggtaaccgggaacgggtacgggtaaccgttttacgggtaaaccgttttaacggttaaccgttaacggtaaacttaaaaccggtaaacgttaacggaaacgttacggggtaaacggttaccgttaacggtttacggttaaggggtttccgggttaacggtacccgggggacggttaaaccgggaccgttaaacggttccggaaccgttaacccggtaccggttaaggtacccggtaaccggtacccggaccggtacccgttacccccggtcccggttaaccccgg

SEQ ID NO: 202764 - DNA, 703 bp, Homo sapiens
  misc_feature: GYAE6OF02I3KCV.21.46.E02.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagactcatctacagggaaaggggtgggtccaggaggcagaactctgggtgtctcaccatggcctggatccctctacttctccccctcctcactctctgcacgnggctctgacggcctcctatgacgtctagacacacggtcccacccgttcggtgtccaggtccgtacccccgaaggaccaacggaccgggaccagggtaacttacccgaaccgtcgtctccgtgacgacggagtacggacctagaacccgtaaaagtaagtcgttcgtacttttaagtaccggttaaacaaaccgaagaaccgccgtaaggtaccccacggtaccccgtggtacgttagtagtaatacgtaataaacgtacacgtaaggacgacggtaccctagacgagtaccgtccgtaggaacgtacgtacttctacggtcgacctccgatcgtacggagacctagtacagttaccgtacgtacgactacgttacacgttagacgttaccggagtacggaagtacgacgagtacgtacgtagttaactacgtagtaacaacgtagtacctagacgtaactaggtactcggtaggtcggtacgtacgggtacgaccggtaagctcggtacgtaccggttacgttagacgaccggtaccgtaccggccgttacccgcccggttaaccgg

SEQ ID NO: 202765 - DNA, 863 bp, Homo sapiens
  misc_feature: GYAE6OF02HWM1V.21.46.E02.1.454.CMB.1.raw
  modified_base (136)..(136): a, c, t, g, unknown or other
  misc_feature (136)..(136): n is a, c, g, or t
  modified_base (165)..(165): a, c, t, g, unknown or other
  misc_feature (165)..(165): n is a, c, g, or t
  modified_base (218)..(218): a, c, t, g, unknown or other
  misc_feature (218)..(218): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacnggctctgacggcctctatgagctagacanacgccacccgtggtgtcagtcgtacccgaggacacggaccggcgaggactccncgtcggcctgtacgacgacgtagtcggtacgtacgaacgtaaaacgtaaagtgttcggttactttaaggttaccggtaaccaaaacgaacggaaccggtccggaacggaccccggtaaccggtccccgttagggttacgttacggttaacgtaataaacgtaagtaaaacgtaccgtacgtacggtaaacggccggtaccgtaacgaacggacgtaaccgtccgtaagacggtattaaccgtccggtacgtaccgggtcctaccgtacggtacgtaaaccggtaacggggctaacgaccggttaccgtacggtaaccggttagtaacgttaacgtacgggtaacgtaacggtacgtaccggtacggaacgtaggtaaccgggaacggtacggtaacgtaacggtaacgtttaacgttaaccgtacttaaaccgaaacgtaaccggttaacgtaacggtaacggtaaaccggtacgtaaacgtttaacggttaaccgggtaggggtttacccggtaccggggtacgggtaacggttaaccggtacgggtaaccggttaccgggtaaccgttaacgggaccgggttaaccgaaccgggttaacccggtaaccgggtcccggttacccggttccccgggttaacccgg

SEQ ID NO: 202766 - DNA, 649 bp, Homo sapiens
  misc_feature: GYAE6OF02HP16Q.21.46.E02.1.454.CMB.1.raw
  modified_base (132)..(132): a, c, t, g, unknown or other
  misc_feature (132)..(132): n is a, c, g, or t
  modified_base (136)..(136): a, c, t, g, unknown or other
  misc_feature (136)..(136): n is a, c, g, or t
  modified_base (524)..(524): a, c, t, g, unknown or other
  misc_feature (524)..(524): n is a, c, g, or t
  modified_base (558)..(558): a, c, t, g, unknown or other
  misc_feature (558)..(558): n is a, c, g, or t
tcagtcgtcgctcgcacgaccggtgctcgatttagactcatctacaggggaaagggggtgggtccaggaggcagaactctgggtgtctcaccatggcctggatccctctacttcctcccctcctcactctcngcanaggctctgacggcctcctatgagctagacacacgcccacccgtggtgtcacggttcgccccaggacacggaccggcgaggactccgaccgtgtctcgtcgacgagtacggtcggactacggaaacctaaaagaaacttgtcgtacttagttacggtaaaccaaacgaagaacggaccgacggaccgaccggtcccgtggttacggttacgtagattaataagtaaacgactaccgtaggacgaccggtaccagacgacgtacgtacctaggacgtacgtacttcgtacgtcggtactaccgacgtacgacggaacggtcacgtacgttacgacgtcgttaggacttacgacgtaggtacaacgcgaggacgacggaggacgacggtanacgtacttacgtacacgtaacgaaacgtggtaanacgtaaggactacggtactcgtaggttcggtacgtcgggacggtacgagtcgacgtcgacgtacgagcacggactacggctcccgacgtcg

SEQ ID NO: 202767 - DNA, 840 bp, Homo sapiens
  misc_feature: GYAE6OF02G0KFA.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcgctctctgcacaggctcgtgaggcctcctatgagctgacacagcctacctcggtgtcagtcgtccccaggacaggacggccaggactcacctgctcgtgccagacgtcggactacggaaccaaaagtaaattgtcgtacgtttaagttacgggtaaaccaacgaacggtaaacggacccgtaacgggcccgaaccgggttcccccttagggttacggtttaacggtaggtaattaaacgttaaacgttaaaaacgacctacggttaacggaacgggaccggtacccccttaaggaaggtaacgtaaccgttcccgtaggtaccggtcgttaacgtttccttaccggttcggtaccccgttaccgacggttccgaccggtacggggtaacaccgggacgtaaccggttaccgtttaacgggtttacgtaaccttaacgttaccggtaacggtttaacggaacgggttaccgaacggacggacgggaacggtacgggtacgaccgtagttaaaccgttactttaacgcgtttaaaccaaacggttaggtaacgtaacggtaggtaaggttaacggttaaccgtacggtttagggtttacggggttacggtacggggtaccggaacgggtaaccgtaacggttccgtaaccgggtccggtaaccggttacgacggtacccggtaacggtaccgggtcccttcccggtacccgttcccgg

SEQ ID NO: 202768 - DNA, 832 bp, Homo sapiens
  misc_feature: GYAE6OF02HLMOX.21.46.E02.1.454.CMB.1.raw
  modified_base (248)..(248): a, c, t, g, unknown or other
  misc_feature (248)..(248): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccgaggacaggaccgcaggatccacgtgctctcgcgagatggactcgaaccaaaagaatntgtctttagttacggtaccaacgaagacgccgacggaccgaccggcccgttagtacgttagtgaactaataacgtaaagacctagtaggaaggaccggccctagaaggtactactaccccgtaggacgtacgttaacgtttccgtaccggttcggacccttaccgaacggtccgtttacgggaaacgggggaactaaccggacgttaacgggttaccgtttaacggtttacgaaccgtttacgtaaccggttaagggttaacgggtaaaccgggtcccggaaagggtaccggtaaaacggggtaacggggaaacgggtacgggttaccggtacgttaaaccggtttaattaccggttaggtaaacccaaaagggttaacgtaacggtaaacgtaggggttaaacgggtaacggtttaacccgagggtttaagggtttaccggggttagggttaccggggaccggggaaacgggttaaccgtacggtaccggtaaccgttaacccgggtacccggtttaacgggcccgttaaccgggacccgttaaaccgggtccccggttaccccgtcccccgggtttaaccgg

SEQ ID NO: 202769 - DNA, 724 bp, Homo sapiens
  misc_feature: GYAE6OF02GB652.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctccccctcctcactctctgcacaggctctgaggcctcctatgagctgacacagcccaccctcggtgtcagtcgtccccaggacagaccggccagggactccacctgccttcgtcgcagagtggactcgaaccgaaaagaattgtcgtactttagttcggaaccaagtaagaacgaccgacggaccgaccggcccgttgttacgttaggtagtaattattaaataacggacctacgtaggaacggaccggtccctagaagacgtacctccgtagacgtctattcacgttgcctccagtcacggagggtacacgcgtagtccgtagttcgaacttagtaccgtaaggtacgtaacgtccggtaacggacaagggacggaacggtcgggtacttacggtaactttaacgttacggtaacgtaaccgaaacggtaacgtaacggaacgttaacgggtaaggtaaccggtttacgtggtttaagggttcgggtttacgggtaccggggacgggtaacgggaacgtacgggtaccgtaacgggtccccgttaaccggtgggtaaccggaccggaaccccggtaagggtccccttaccccgggacccgtttaccccggg

SEQ ID NO: 202770 - DNA, 904 bp, Homo sapiens
  misc_feature: GYAE6OF02JKFZT.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctcgtgacggcctcctatgagctagacacacgccctacccgtggtagtctacgtccgtcccgagactacggaccggacgaggactaccaccgtcgctacgtcgacagtagtacgggtacctaccgaaccgtaaaacgtaaagttacgtgtaccgtttttaacggtttaccgggaacccaaaacggaaggtaaccgtccgaccgggtacccgtacccggtacccccgtttggttaccggttagttacgaaaatttaacgtaaacgtaaaacgtaaccgtaacgtaacggtaaccgggaccgtaccccgtacgtaacggtaactaaccgttcgtacggtaccgggacgttaccttacgttccggtcgggccgttaacctacggtcggtaacgacgggaacgtaccgacgtaacggtttacgtacggttctaaccgttacgtaaggaaccggttaagacccgtaacggaccgggaaagttacgggaccggtacgggtaaccgttggtttaaacccgactttaaaaccggtttgtaacccggtaaaccggtaacgttaaaggggttaccgtaaacggttaacgggttaaacgtaacgggtttaccgtacggttttagggtttacccgggttaggttaccccgggggagtaaccgggtaaccggtaaacccgttagggtacccgggtaaaccccggtttacgggttaggaacccgacccggggttaccccgaagggccccgttttaccccggttacccccgtaacccggg

SEQ ID NO: 202771 - DNA, 814 bp, Homo sapiens
  misc_feature: GYAE6OF02FTHBB.21.46.E02.1.454.CMB.1.raw
  modified_base (92)..(92): a, c, t, g, unknown or other
  misc_feature (92)..(92): n is a, c, g, or t
tcagtcgtcgctcgcacgaccggtgctcgatttagactcatctacagggaaagggggtgggtccaggaggcagaactctgggtgtctcaccntgggcctggatcccctctacttcctcccccctcctcactctctgccacaggctctgaggccctcctatgagcctgacacagcccaccctggtgtcagtcgtcccccgaggacacggaccggccaggactccacccgtgcccttcgtgccgtagacgttgggacctacggaccaaaacggtaacttagttcggaccgttttactacgggttaaacccaaccgtaaggaccggccccgacggtaccccgaccgggtacccccttggttacggttactggtaaactattaacaaacgtacagtagacgacggtcccctagaacggacgtacctccccgtagacggtccgtagttcccacgtccggtccttaccgacggtcctaccggggtaacggaaccacggtaccctaaccgggttctacccggtttacgaaactttccgacggtacggtaacggtaacctacccgggaacggtaccggaaacgggttaccggaaccgggcgttacccgtaggttaacctacttcccgtaactaaccgaaaagtaccgtaagtaaccgtaaacggttaggtaacgttccctaggtacggttcggggtacggttaccgggacggtaacccggtaacggtacccgttacggtaccccggttaaccggttcccgaacgggtaccccgaaccggtaccccggtacggtaccccgtttcccgacccccggttaccggg
